United States Patent 9,782,462 (MODIFIED POLYNUCLEOTIDES FOR THE PRODUCTION OF PROTEINS ASSOCIATED WITH HUMAN DISEASE) - sequence listing, part 21

SEQ ID NO: 23184 - DNA, 3684 bp, Homo sapiens
gagcattctctaccattgcccagctgaaagcacctagctcatagattctctgtggggagagtgaataaaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaa

SEQ ID NO: 23185 - DNA, 2614 bp, Homo sapiens
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatctctgctctgaacaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttt

SEQ ID NO: 23186 - DNA, 1674 bp, Homo sapiens
acacaaattagcgtcagtccactgactgtcgcctacaataaattaggctgagtctaaaagaaatcagtctgcatagaaagaccaacaaccagcaccacttccttgctttttccagccatgaatgcttccagtcggaatgtgtttgacacgttgatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcagg

SEQ ID NO: 23187 - DNA, 2616 bp, Homo sapiens
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtg

SEQ ID NO: 23188 - DNA, 5293 bp, Homo sapiens
ggcgctgcggagggagggggcggcccggcccggcccagctctgcccccggccggcccgaccccggccccggcccccggacaagcccttatctgatcccagctccgggtttaagagtcctggcccggcccgtcgcacagctctgctcctaactcctgcccgccccgtccgtccatctgtcccgctgccccgcggcccatccaaggggccactccacctcggacccaagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggtcaatgtgactttccaagtagacacagcctctgacagccccttccttattctaccccttaccttctatcatgtggtagatgagaccagtcccttgaaagatctccctcttcgcagtggtgagggtgactttgagctggtgctgatcctaagtgggacagtggagtccaccagtgccacctgtcaggtgcgcacttcctacctgccagaggagatcctttggggctacgagttcacacctgccatctcactgtcagccagtggtaaatacatagctgactttagcctttttgaccaagttgtgaaagtggcctctcctagtggcctccgtgacagcactgtacgctacggagaccctgaaaagctcaagttggaggagtcattaagggagcaagctgagaaggagggcagtgcccttagtgtgcgcatcagcaatgtctgatgacctgttcccactcccccattcctctggtctcttttcctctcttccaatgccctggtaaggaatactacccgggtttactggagatcccccgaagcacccatcctccactccctcttctttaacccagtggcctgttggtagcttaggccaactggagtccaggttcgcctcccactgtcccctttccacttccccagcttctgccccaatacacatacctcccttaagccaggatgggggaaagagtgggattaggctgaagtggcttagaaggcctcagccatgcttggatactcacattaggaggaccatgtggttggaaggatagactgccccctacctcccaccaccaccatgaagtttggtgacttgaggctggagctccctctgttacctttccatctagcaagttcccaaaggcaagactctctctgatggtcactttgtggtctgtgctttcagaaatacaggaatctgatatcaacatatcctagggtttctaccaatctctgttgaaagaagccagggtttgccactgtgaagcttgatttctgctggtgacttctgaccataagctagaaccatggtcgccactgttttccctctgtagtttctcaagtgaacactctcaggatacccagttccctcatagcctctgttctcagagaattggagttggcccaagaaacataaacatataaccacccatatctatcctggattctgaactcttcaatttggagtgactaacacaagttgttatctaaacctttaaacctatcttccaggcagcccagagaagatctgtttccctgtgtcctgtgaatggaaggacccaagccaatatgttcctttgaaaagagtccagtacccaggccccatggaaaggtctgaaaataatattccagattacactgtacctggcttctcttcttcctttcctgctcagcctagatccttcttccttaaccccaactctttgggagaagggagggaaaatgcaagggccttcctctcttaacacggatgctcaagtaaaactagattcacagggcacagattccccagaaagttaacacaatcccaccatgagggatgggtaaattctcagatttccaaactgctgtacagagcctctgagaattggtgatgctttgttaaggtttgggcaggagcagaactctgtggctggcagccactattctcagttacacctcccagtgcccttctgaaaagtgccagctatttcattaggcaatgctggaaggaaatgaaattataccttctgatcaaataaccatggcttccctcagccattcctgagacttggtataaaatgaagaaatcagtgtcatctctactctcctctgccatgaggccattttcagacaagttaaaaagtagactttaagagatcaaactcagcctattccttgttccctggtggggtctgtggtaagggtcagggaagggcatataggcaccagagctttatccaaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaactatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtgtgtctataccttcctatccattgccaagttaacctccatctggtttatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcaccattttgtttccctttcatgaagtacactgtatttccgtcttccacaggggtgggagctgctattgctctagcccctgaaatcaaactcaggagctgaacactttggtgtatgggaggcactaatgggaagcctcaaccctggaatccaaatgccaggactaatagctgttaggctgaagatctcccaaggtcaaggcccagccttttgtgtggctgcaagcagcccaaagagaaagccatggattccagaagagttccaatcctggcatttgggcatggagggtgatgctttggttttgatgcttctgaatgaaaatgaggagtggggttaccagctgctctaggggatggtgaagttccatgagaggcttccgaaatctctgcaatgtgcttcaccccattattcccccaacccctgtcagcctaataaaatcatccagtagtttccctataaggtctgagcagagaaagaaagccagttatactattgctacaagtccaggacactgtgccctctccatggctgctgccctggtcctttattcttgctagctaacctagttcacttgtacagtaacacactacctttgctggaaagttagcatgggtctccaggctcagtaatggccaactctactgatgcagaagtatttagggatgttttttccattcattgcactaaagactaaaccaggtcaaatttatctaggaaaaaaaaggtgtgtaagatttgttttgtttttgtctgttaaaaataagctactaaataaaatggatgactctttggttgtca

SEQ ID NO: 23189 - DNA, 2801 bp, Homo sapiens
ggcagggttgggggctccctaggcgccaggcaggtgggctcaagggtgaggctgttttttttgttttgttttttgtttttgagacggagtctcgctctgtcgcccaggctggagtgcagtggcgtgatcttggctcactgcaacctccgcctctcgggttcaagcgattctcctgcctcagcttcctgagtagctgggattacaggtgcgcaccaccatgcccggctaacttttgtatttttagtagagatggggtttcaccatgttggtcaggctggtctcgaactcctgacctagtgatctgccctcctcagcctcccaacgtactgggattacaggcgtgagccaccgcgcccggcctgaggctggtattaagaagtgaagtgggacccaggtggaggtaaggaagagtctggtggggagttatctcagaagtgaggccagcacaggctgagtgcagccccagggtgagaaggtgcccaccgagaggactctgcagtgaggccctaggccacgtccgaggggtgcctccgatgggggaagcccctccctgggggtcaccggagccatgctgtcccgcaagggcatcatccccgaggaatacgtgctgacacgcctggcagaggaccctgccaagcccaggtaccgtgcccgccagcggagggcccgctttgtgtccaagaaaggcaactgcaacgtggcccacaagaacatccgggagcagggccgcttcctgcaggacgtgttcaccacgctggtggacctcaagtggccacacacattgctcatcttcaccatgtccttcctgtgcagctggctgctcttcgccatggcctggtggctcatcgccttcgcccacggtgacctggcccccagcgagggcactgctgagccctgtgtcaccagcatccactccttctcgtctgccttccttttctccattgaggtccaagtgactattggctttggggggcgcatggtgactgaggagtgcccactggccatcctgatcctcatcgtgcagaacatcgtggggctcatgatcaacgccatcatgcttggctgcatcttcatgaagactgcccaagcccaccgcagggctgagaccctcatcttcagcaagcatgcggtgatcgccctgcgccacggccgcctctgcttcatgctacgtgtgggtgacctccgcaagagcatgatcatcagcgccaccatccacatgcaggtggtacgcaagaccaccagccccgagggcgaggtggtgcccctccaccaggtggacatccccatggagaacggcgtgggtggcaacagcatcttcctggtggccccgctgatcatctaccatgtcattgatgccaacagcccactctacgacctggcacccagcgacctgcaccaccaccaggacctcgagatcatcgtcatcctggaaggcgtggtggaaaccacgggcatcaccacccaggcccgcacctcctacctggccgatgagatcctgtggggccagcgctttgtgcccattgtagctgaggaggacggacgttactctgtggactactccaagtttggcaacaccgtcaaagtgcccacaccactctgcacggcccgccagcttgatgaggaccacagcctactggaagctctgaccctcgcctcagcccgcgggcccctgcgcaagcgcagcgtgcccatggccaaggccaagcccaagttcagcatctctccagattccctgtcctgagccatggtctctcgggccccccacacgcgtgtgtacacacggaccatgtggtatgtagcccggccagggcctggtgtgaggctgggccagcctcagctcagcctccccctgctgctcatccagggtgttacaaggcacttgtcactatgctatttctggcctcagcaggaacctgtactgggttatttttgtccctgctcctcccaacccaattcaggactggctcacccctctcccccgcccaaggctgcagaggctgtgggaggtactgggccctagagctgtgcgtccagccagtcctgggtccccacgattgaccagccacactctgggccggtggctggggaagaacaatccccgagggctgctgctttgcgtctgtggctccaagaagtgcctgtggtcaggccccagctctacttggtccctgaaaaagcacctggctaagggctgggcctggccagcagggagggcagttgatgagagagggtgttcccgctggagggttggtgctgtggagcctacaccggcagggacagcctggggctgacagggctcccctccgagggccagtttcaggtctggaaggggaggaagcaggggaaggtgacctgaggaggctcggctttgtagagccccgctcaggcacagggaggaggagatgccagggctcctgccttttgccacatcggcctcgtgcagtgagggctctgtgggctggggctgctgcccctgcctacctcctgcctgtccccagaggctgaggagagggggtactgtgcccaccacacatgattaggcctcagacccaactctggtcctggctccacaacagtggctgccactcactttgtccagaaggtggcttgggggtggatatctttgggttgctggaaaaggtgtgggaaggttcaggatggtgggagggactgaggtccctgaggtgaagaggcccttggtcctgacgggtttgacccgtgcctggacccttggagcagtgttgtgtgaacttgcctagaactctgccttctccgttgtcaataaagcctccccctcatga

SEQ ID NO: 23190 - DNA, 2455 bp, Homo sapiens
ggcgcggagctgggtgcgcgccgagcctctgcctcccgccgcctcctcgccctccattcctcgctccccgtcttctcccggccacaccgccactgctgccgcctccctgggaacagtagccgggggagggggactggcgcggtcagagcctgcgaggaggtgcggggcgccggggcgtaggggagcgcgccgggccctgcccgagatcagataacagccggcgggggagggggtgggccggccgtgctcacagccggaccgagggaccgacgccagccgccccggcccaagcgagcgcccagcggccgggggcgccgtccaggcgcgcgcccccgacccgtggctggaccagggcgatccgctttgcagagaagacgcgcccctcggcatggagcgcccccgggagctgccctgaggcggtggcggcagcggcggcgatgcagccagcgcggcagctgccggggccaggaacggccgcccggagcttggaggacgccgagcgcgccgcgcccgggccactgaccgaggatgttctagtgactggatcctttccagttggtgcctgggaaatggcagccactactaattcagccttgaagacagtaccgtgcccactcagcaccattacatagaagatagaactcaagaggagccgccctgcctggagctagcctgggggcgagccagggtcccccaacccccgggatgaccgcggccagccgggccaacccctacagcatcgtgtcatcggaggaggacgggctgcacctggtcaccatgtcgggcgccaacggcttcggcaacggcaaggtgcacacgcggcgcaggtgccgcaaccgcttcgtcaagaagaatggccagtgcaacattgagttcgccaacatggacgagaagtcacagcgctacctggctgacatgttcaccacctgtgtggacatccgctggcggtacatgctgctcatcttctcgctggccttccttgcctcctggctgctgttcggcatcatcttctgggtcatcgcggtggcacacggtgacctggagccggctgagggccggggccgcacaccctgtgtgatgcaggtgcacggcttcatggcggccttcctcttctccatcgagacgcagaccaccatcggctacgggctgcgctgtgtgacggaggagtgcccggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggtaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgagattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagcgccaactccttctgctacgagaacgagctggccttcctgagccgtgacgaggaggatgaggcggacggagaccaggacggccgaagccgggacggcctcagcccccaggccaggcatgactttgacagactccaggctggcggcggggtcctggagcagcggccctacagacgggagtcagagatctgagccaaccttggccgacatgcagcatccacccccggctggggagaggccccgcggtcgctcaggggccccgggtttgagcagaacgggcccagtgccctgggttgcagactcagtagcgttttagtcgttttatgtttctttgcaacggcctcagaagtttggccggagagggggcagccagagcggcagcccccggcctcagaggctatcacaggctcagggcaaagaagtggcctcctggggggccaggccacgagggccagggcttctgcctgaagatggagctgcagcctgcggggaagcagctcagctcgatggtgggcccagcctctgctgtccaaggctggctagctgcggtgctccttgctggtttttaacttggggagaaacaccgggtttcagctttcttgaccttagcttgggtgagactgtttacaaaaaaaaaaaa

SEQ ID NO: 23191 - DNA, 2950 bp, Homo sapiens
accagtccaagaagagaacctacaaactagacttgtagattaaaattatctgatcaaaaaggcagactctgtaaatttccttaagacctaccttggcataaaggctgacccagcaaaagaactgagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagctactttttctttactgtatctcatgttttcttttttcaatgctaattatagctctctacatcacggtaatcatgcctatgcctacataagaatggctgagctaacaatacacattctggaaacataacactctacattacaaagtttgttacctgctgaaatcaatgtaactcaacttgacagacacttatacagaaatgttgctggtgaatttataagaatgtggtatgatactagtaatgaaggcaaaatggacagtgaagtttaacacaactgaactctaagaaaatcaaccattaatctctcattttcatctgcaaattgaagcaacagtttagtttcaaacctagctccctgggtggaatgacgacttcactatacttagtgaatatcctttaagagctgggatttttttcaagacaacaaagatcattcatttggttctttatactatgaaacttgagtaagtattacctccttaatttttaacaactaagaacaaaaattaacgagaaaaacaacaaagtacagatttatacataaacctaaaagcatttgaacatgacacccgaacacatacatatatgttcacttatttgtggcagaaggtgatcagataagctccagcccaaatggaacctgtggggtggtattttgcattgcaaggagacgcaaaattttattttaaaactgtcctccataataatcaaacggtgattcatctaaatgacttctagcaacctaagtaaaaacattcccctcctatgtatgattcatttgatcatataaaacatcatgatggctctaattcataaatacaaaaatatatttaagtctttatagatataaagctttacttagatataacttgagtgagtagggaaaaaaatctacagtagataaagcaaaagataattaggcaacaaagcattttcaaactcaaattcctgtttccaacttcaaatagttttttctataaacacaaaatcagtgtttattcaccagtaggaggttggactagatgaactctattatttctttctaaatctaatagtctataaaaattatgtttcctctgttttttattttatctatgctaaaatgagccctttcccttatgtccagtttaagatgatcatttgcatgattttcatttcaataaaaaaaagagaaactgtccttaaaacaaaacaaaaaccaaaaaagtcaccctatcaggtttcaaacagatttgtggctgttcttttctgaaatttcccttattcaggtttctgtgggaaaaatgaaagattaaccttccccactggtgatgacctaggcaggaatcatctcttgaaataaatactagctgagtaaaggcaagcaggtgtgaagagcagggctcagcagcaagtcacatttttctactatttgaccaaaaggaaaagaaaataaagaagaactctggagtggtctaagactgataatagcagaagaatatcaagaacacagaaacttaattattgtgaacttttgctgtttgaaaatcttagacattcattcttaagtagaaatcagaccaacagattttcccaacccaagactattgtaacacataaagacagcaagaattcttatttctataataaattaacaagattcacctaacctttgaaaataaagtagtattgaagactta

SEQ ID NO: 23192 - DNA, 1099 bp, Homo sapiens
agtccaagaagagaacctacaaactagacttgtagattaaaattatctgatcaaaaaggcagactctgtaaatttccttaagacctaccttggcataaaggctgacccagcaaaagaactgagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagctactttttctttactgtatctcatgttttcttttttcaatgctaattatagctctctacatcacgg

SEQ ID NO: 23193 - DNA, 1177 bp, Homo sapiens
agcttactaatttactcttgattttagagaaatacagcctgagatggacagcagtaattgcaaagttattgctcctctcctaagtcaaagataccggaggatggtcaccaaggatggccacagcacacttcaaatggatggcgctcaaagaggtcttgcatatcttcgagatgcttggggaatcctaatggacatgcgctggcgttggatgatgttggtcttttctgcttcttttgttgtccactggcttgtctttgcagtgctctggtatgttctggctgagatgaatggtgatctggaactagatcatgatgccccacctgaaaaccacactatctgtgtcaagtatatcaccagtttcacagctgcattctccttctccctggagacacaactcacaattggttatggtaccatgttccccagtggtgactgtccaagtgcaatcgccttacttgccatacaaatgctcctaggcctcatgctagaggcttttatcacaggtgcttttgtggcgaagattgcccggccaaaaaatcgagctttttcaattcgctttactgacacagcagtagtagctcacatggatggcaaacctaatcttatcttccaagtggccaacacccgacctagccctctaaccagtgtccgggtctcagctgtactctatcaggaaagagaaaatggcaaactctaccagaccagtgtggatttccaccttgatggcatcagttctgacgaatgtccattcttcatctttccactaacgtactatcactccattacaccatcaagtcctctggctactctgctccagcatgaaaatccttctcactttgaattagttgtattcctttcagcaatgcaggagggcactggagaaatatgccaaaggaggacatcctacctaccgtctgaaatcatgttacatcactgttttgcatctctgttgacccgaggttccaaaggtgaatatcaaatcaagatggagaattttgacaagactgtccctgaatttccaactcctctggtttctaaaagcccaaacaggactgacctggatatccacatcaatggacaaagcattgacaattttcagatctctgaaacaggactgacagaataagacttatccattttttaatgtattaaatacacccagccagttatgcagcta

SEQ ID NO: 23194 - DNA, 2863 bp, Homo sapiens
aggtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtc

SEQ ID NO: 23195 - DNA, 532 bp, Homo sapiens
aggtgtttggagagcccggactggatgcccactagaatcctgtgctggcaacctgtctggactgagcatttctctgacttgacataacttcccatccagccaggagtctgcactcttcagtctttgcaggacaggtgggagttaaccaagaaagggagaaaatgaagaaccttcaggaaggaattcatgtgccagatgtgggctgagagggcacccagctgctcaggaaggggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatga

SEQ ID NO: 23196 - DNA, 665 bp, Homo sapiens
aaaatattctagactcttcccttccagcgctcactgtttacttcctctgcacttccccttcctgcctccccgtgtgccggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattga

SEQ ID NO: 23197 - DNA, 715 bp, Homo sapiens
aggtgtttggagagcccggactggatgcccactagaatcctgtgctggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattga

SEQ ID NO: 23198 - DNA, 2914 bp, Homo sapiens
acaggagcacgtagcctgcaggtgtgggttgtacacaggcttccccctgctgagtcagttccccagatctcttcatcacttccccagatctctgggatcttcagctgagattgggccccagcacctggactcaaggacaggtgggagttaaccaagaaagggagaaaatgaagaaccttcaggaaggaattcatgtgccagatgtgggctgagagggcacccagctgctcaggaaggggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtc

SEQ ID NO: 23199 - DNA, 2747 bp, Homo sapiens
ctgtctttcacccataaaaactgaagccatgtgccagaagccctcgtggctcaagggctctgtccttggacacggatgagggcagctgggcggtgggaccgaggctctgcctgaatgctcagcttctgcaagctggggtggagagtgtgttcctgcctaccggctcagccagcacaggagcacgtagcctgcaggtgtgggttgtacacaggcttccccctgctgagtcagttccccagatctcttcatcacttccccagatctctgggatcttcagctgagattgggccccagcacctggactcaaggacaggtgggagttaaccaagaaagggagaaaatgaagaaccttcaggaaggaattcatgtgccagatgtgggctgagagggcacccagctgctcaggaaggggcagtagcagaatcccatggtagccaggtgggtgaaggggagcgaggacgttctacctgccttgaagaagacacctgacctgcggagtgagtgaccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaa

SEQ ID NO: 23200 - DNA, 2732 bp, Homo sapiens
cagatctctgggatcttcagctgagattgggccccagcacctggactcaaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaaaa

SEQ ID NO: 23201 - DNA, 2583 bp, Homo sapiens
ctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaa

SEQ ID NO: 23202 - DNA, 727 bp, Homo sapiens
actctctctctctgtctctcactttctctcctttcctccctccctccctccctccctccttccctatccctccctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggacaggtgggagttaaccaagaaagggagaaaatgaagaaccttcaggaaggaattcatgtgccagatgtgggctgagagggcacccagctgctcaggaaggggcagtagcagaatcccatggtagccaggtgggtgaaggggagcgaggacgttctacctgccttgaagaagacacctgacctgcggagtgagtgaccaggaatgtgggggaaatttatgtcagtcatcaggcaggtactagaagatgctaggggcctcacagacagcttgttcccggctgttaacatggagcagagcgttccctggggctgagcatgggagcccagcacttcttatagtgtttccagagcctggcaatggatgccattcacatcggcatgtccagcacccccctggtgaagcacactgctgggg

SEQ ID NO: 23203 - DNA, 521 bp, Homo sapiens
gcagtagcagaatcccatggtagccaggtgggtgaaggggagcgaggacgttctacctgccttgaagaagacacctgacctgcggatgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgt

SEQ ID NO: 23204 - DNA, 1115 bp, Homo sapiens
gtggctcaagggctctgtccttggacacggatgagggcagctgggcggtgggaccgaggctctgcctgaatgctcagcttctgcaagctggggtggagagtgtgttcctgcctaccggctcagccagcacaggagcacgtagcctgcaggtgtgggttgtacacaggcttccccctgctgagtcagttccccagatctcttcatcacttccccagatctctgggatcttcagctgagattgggccccagcacctggactcaaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagcc

SEQ ID NO: 23205 - DNA, 711 bp, Homo sapiens
ggtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcaggagatgttggaaacagagactggatccctgaggagatgctgttagaccaggctgagctcaaggcttgtccctaaggcagctggtgaaggaaaggttcgacttggtggtagaagccctggactggagtccccacctatgggctgagggatcctccacaagtgattcaacttcttagtttctcacctacaaaaggtgggagttaaccaagaaagggagaaaatgaagaaccttcaggaaggaattcatgtgccagatgtgggctgagagggcacccagctgctcaggaaggggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaat

SEQ ID NO: 23206 - DNA, 595 bp, Homo sapiens
cgtcttcagaggaaggatagctgtacagcgtggtgaaggactcaatgagaagtgaacagtgagagagttttcttcattttgaggaaccctaaacacctatctttcccaaggcaacctgtctggactgagcatttctctgacttgacataacttcccatccagccaggagtctgcactcttcagtctttgcagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 23207 - DNA, 313 bp, Homo sapiens
cgtcttcagaggaaggatagctgtacagcgtggtgaaggactcaatgagaaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 23208 - DNA, 304 bp, Homo sapiens
cgtcttcagaggaaggatagctgtacagcgtggtgaaggactcaatgagaaggcagtagcagaatcccatggtagccaggtgggtgaaggggagcgaggacgttctacctgccttgaagaagacacctgacctgcggagtgagtgaccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 23209 - DNA, 626 bp, Homo sapiens
cgtcttcagaggaaggatagctgtacagcgtggtgaaggactcaatgagaaggtgcattgcccatccttcagagagctctgtgtgaatccataaaaggtgcttaaagcttttcactccatgaagcctcatctgtctcatgaaagcaataaattgaacagtgagagagttttcttcattttgaggaaccctaaacacctatctttcccaaggcaacctgtctggactgagcatttctctgacttgacataacttcccatccagccaggagtctgcactcttcagtctttgcagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaaca

SEQ ID NO: 23210 - DNA, 740 bp, Homo sapiens
cgtcttcagaggaaggatagctgtacagcgtggtgaaggactcaatgagaaggtgcattgcccatccttcagagagctctgtgtgaatccataaaaggtgcttaaagcttttcactccatgaagcctcatctgtctcatgaaagcaataaatgtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 23211 - DNA, 555 bp, Homo sapiens
cgtcttcagaggaaggatagctgtacagcgtggtgaaggactcaatgagaaggtgcattgcccatccttcagagagctctgtgtgaatccataaaaggtgcttaaagcttttcactccatgaagcctcatctgtctcatgaaagcaataaatataacttttaagtggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 23212 - DNA, 413 bp, Homo sapiens
cgtcttcagaggaaggatagctgtacagcgtggtgaaggactcaatgagaaggtgcattgcccatccttcagagagctctgtgtgaatccataaaaggtgcttaaagcttttcactccatgaagcctcatctgtctcatgaaagcaataaatgcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 23213 - DNA, 4002 bp, Homo sapiens
tgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgc

SEQ ID NO: 23214 - DNA, 4009 bp, Homo sapiens
gagaactcagtggcctttgtctgtggtgaatgtatccggaaaggcaaagaagagagagattctcctgtggggtttctcatctccatggcggtaggtgctgacagcttcagaagggtactaacagggccaagagaaaagggccctgagatgctcagctacggtgctcttacaagatgaaaaggacatggggttcagatctgcacttcatcatctttcactaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgc

SEQ ID NO: 23215 - DNA, 3921 bp, Homo sapiens
tgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgc

SEQ ID NO: 23216 - DNA, 5363 bp, Homo sapiens
gcgcactggagccctggccagcgcgcagccttcccggcgccggcgggctgggtcttgggaattctggtttgctttggctcactcgctttttacaaaccactggatcttacatgcctctgtaccccccacttccactccatgtccccatgctcctgcgccagcaacaggacatgttctctggatgtcagctgagtcattaaagtaactctgcatgtcagtagacagaccttggtagaaccacaaggctcccagagacacccatctctcctcatttttttggtgtgtgtgtcttcaccgaacattcaaaactgtttctccaaagcgttttgcaaaaactcagactgttttccaaagcagaagcactggagtccccagcagaagcgatgggcagtgtgcgaaccaaccgctacagcatcgtctcttcagaagaagacggtatgaagttggccaccatggcagttgcaaatggctttgggaacgggaagagtaaagtccacacccgacaacagtgcaggagccgctttgtgaagaaagatggccactgtaatgttcagttcatcaatgtgggtgagaaggggcaacggtacctcgcagacatcttcaccacgtgtgtggacattcgctggcggtggatgctggttatcttctgcctggctttcgtcctgtcatggctgttttttggctgtgtgttttggttgatagctctgctccatggggacctggatgcatccaaagagggcaaagcttgtgtgtccgaggtcaacagcttcacggctgccttcctcttctccattgagacccagacaaccataggctatggtttcagatgtgtcacggatgaatgcccaattgctgttttcatggtggtgttccagtcaatcgtgggctgcatcatcgatgctttcatcattggcgcagtcatggccaagatggcaaagccaaagaagagaaacgagactcttgtcttcagtcacaatgccgtgattgccatgagagacggcaagctgtgtttgatgtggcgagtgggcaatcttcggaaaagccacttggtggaagctcatgttcgagcacagctcctcaaatccagaattacttctgaaggggagtatatccctctggatcaaatagacatcaatgttgggtttgacagtggaatcgatcgtatatttctggtgtccccaatcactatagtccatgaaatagatgaagacagtcctttatatgatttgagtaaacaggacattgacaacgcagactttgaaatcgtggtcatactggaaggcatggtggaagccactgccatgacgacacagtgccgtagctcttatctagcaaatgaaatcctgtggggccaccgctatgagcctgtgctctttgaagagaagcactactacaaagtggactattccaggttccacaaaacttacgaagtccccaacactcccctttgtagtgccagagacttagcagaaaagaaatatatcctctcaaatgcaaattcattttgctatgaaaatgaagttgccctcacaagcaaagaggaagacgacagtgaaaatggagttccagaaagcactagtacggacacgccccctgacatagaccttcacaaccaggcaagtgtacctctagagcccaggcccttacggcgagagtcggagatatgactgactgattccttctctggaatagttactttacaacacggtctgttggtcagaggcccaaaacagttatacagatgacggtactggtcaagatgggtcaagcaagcggccacaagggactgaggcaagcacaatggtttcaaagaaagactgtaagctccatgattagcataaagcactaaccatgtctccatgtgacccgatggcacatagatgttgtagaataagttatgggtttttatgttttgttttgtgtttttccaaaacttgaacttgcaggcaagccttggttgggtatttgatttatccagaatgcttctctttagggaacaaggatgtttttaatggcataacaaaggcaagactctgccttaatttttgaaaagctgctaactacatgaacacaaatgtgtatttttgttgcagtgtagttttccttttgtgtaattttaaagtcagtgttgaattttattgaaagctcatgatgcgcttcaaagtggcaagtatttggctattaactgccaaaacaagagcctgattttttgaggccagtaattcgtttgctagaattgattttttttctctctctctttgttacataagggcattatgtaacactagccgaatggtagcctctgggttgttgtttttttcttttcctccatgatgttaatgggttatctcaaattttaagttaaactacctaaaataaataccaaagataatgcatatttttgcacagtggagcttacacttaaaagaaaacaaagccccatgggctgccttgaaatcaagagacaataactttgaacctcagcaagaccttgaaccgccggttcattttgcaccttattcagaaaatagagcatcatactcaccgagtctagtcagtgtagtgcttttaaaaattttgtcctttcatgtaacttttttattttaagaggaagaagaagaaaggggcacacacacacaataccgacgtctatcctttcctgctaggcagtgctggccaggctcatgtgtagtgtgcgagatggtgatgtactcttatatttttctgggcttttccttttgcacattccaaaattcatttcataagacaagatcttcataggacctccttggcatcctggcattctcaaaactgagccatccagcatgaaagataaatgggtttaaacccttgctgctgaatttattgcctggactgtcaggacatcaccagcccaccttcaccttagggaagatgccacacctggcctccacacttgctcttctgatcagtctgtctggattgagtcctacagtgtcagatagggcggcaaatgccaaagcagggaaacagggaggtgtggacaagccagtttgatgcagcacttcagatcaagtgcttaggaaggagaggaaacttgccttttttatggcagaggatagtaatgaaaatgtctcagtattttagggtcaatgagagccataaaaatataacataatcacaagtaaaggagataatggtctaaaacagctatttcccttttctgtgtgcatacttatgactgaatgtgagctaagcattttctcctgtggagccctagagcaggttactaaggaaggacacattgttttccagaagcctcccctgcctggctgactgccttgctagaaacataattttttttttctcactgaagctcaataatggaactctttttttttttttttttaatttaaagttccctatttgtgaattctgggattactgacttttctttttaattggagtctcaaaatcaactctcttatggtattatatctctgtatgccattaaaaaacagcttgttctagaatcatgtattttgtaaactgatgtttgtgatggtctctggttcttgaacagccatatctgaatgccgtgcctgcaaaactatgacaatttttgctgttttcagccttcagatttgatggcttgggaaactgaggtgttattttcaatgaaacaaagaaagagatgttaagcaagtggttgttttagatccaaatgtaaaggcaggtttgggaaggtgtttaaagagttggaggaattggggattgagttgtaaagaaaacttacagaagaggcaacaatttggttcttgacagtgagaggatattgagggcttcagctgctgctattatgatgttttgcaaaggaaaataatcaaaccaaagagtattcagtgatatgtaaattaaatgaagatacagtggagaatgggggtgaccacaaaagaggctccccctaaacacacagtgctgccacttaaaaagacttgagaaatttgaaagggggtgggtatggggggggcaagaaagagggagggaaatctttcaacttatttctgaaaaagagaaaaaaatataaaatttctggtgcacaggtttgttttttcaagaaaattttgcagaagctatgtttttaaagtgtacattttataaagtttatcagatattttcatatttaaagccaaatgtaaatagaggtctgtaaagaaaaataattgccatagaaagtataatttcagtgcagtaatttctgagagctagtacctatatgctaccggttagcatggttttagcaaatatataccagccttataaggttcgtattgctatgttcttctgttatttatttcagcatggactgttcatttgaaacctttttctagttattagcgttttaacagttacaagctttaaatggcaattttttttttttttttttttttttttttttttttgtcaagagccaagacacaggtaatgcacgacattgattgctgcattttaccttcaaaatatttgtccttattgactgggtctccttaattaatgtacacatgtcattagaatgcagacggaggggactcaccatgaatatctggggttgattcccagatgtgtgttgcttctctattgcaagcagattccctgttggatttacttcggatttattcccttttaaagaatttttgcccatatctggaagggcactatatttttgggaggagccatagattcctggttatcctatttttaaacaaaatgtagacaaagtgaactctattttgattattgagaaaggagtagttttctatccctctaagagtatacttgaatcagacattttaaggatgtcactatggcactgttgtcatttccaaattcctagaaaagtttgttttactttgtttttattctgttaatgcattctttcttctctttacttcctttcttaccagtacactcctatctcaactctgtttatttgatgagttctgtcccgtaaatcatatttcccttacaattaataaatgtcacttcatattttataataaaccactcagtaaaagcaaaagcttgtcctgagaagtagagtgagttctttttcactctgtgtctaataatgttaaggtgggaaaaaaaaaagtgtggcatagctacctgcccatccccaaccctcagcaaagtagaatctcttttctggtaattttgggtttccgctctgggctctggcaagttgaacaatcctagccattgacaatcgtgatagttattattttcccatttgctgtctttttgtatctaaagtcttcctattgtactgcacaaaccatggattgtacatatttttatatattatgtcttattttattatttct

SEQ ID NO: 23217 - DNA, 1685 bp, Homo sapiens
tgggaggcgctgaagcgagggcagatctgagtgtctgtaggagttgctattccaaaaaaaatcattactctctaattgttctgattttagatcagcaaagcgtgccgggcggtggtggagagactgagggcggacaaggcgagagggaacgagccgtccacccttcggagaagcctaggcgccttgacatgttctctggatgtcagctgagtcattaaagtaactctgcatgtcagtagacagaccttggtagaaccacaaggctcccagagacacccatctctcctcatttttttggtgtgtgtgtcttcaccgaacattcaaaactgtttctccaaagcgttttgcaaaaactcagactgttttccaaagcagaagcactggagtccccagcagaagcgatgggcagtgtgcgaaccaaccgctacagcatcgtctcttcagaagaagacggtatgaagttggccaccatggcagttgcaaatggctttgggaacgggaagagtaaagtccacacccgacaacagtgcaggagccgctttgtgaagaaagatggccactgtaatgttcagttcatcaatgtgggtgagaaggggcaacggtacctcgcagacatcttcaccacgtgtgtggacattcgctggcggtggatgctggttatcttctgcctggctttcgtcctgtcatggctgttttttggctgtgtgttttggttgatagctctgctccatggggacctggatgcatccaaagagggcaaagcttgtgtgtccgaggtcaacagcttcacggctgccttcctcttctccattgagacccagacaaccataggctatggtttcagatgtgtcacggatgaatgcccaattgctgttttcatggtggtgttccagtcaatcgtgggctgcatcatcgatgctttcatcattggcgcagtcatggccaagatggcaaagccaaagaagagaaacgagactcttgtcttcagtcacaatgccgtgattgccatgagagacggcaagctgtgtttgatgtggcgagtgggcaatcttcggaaaagccacttggtggaagctcatgttcgagcacagctcctcaaatccagaattacttctgaaggggagtatatccctctggatcaaatagacatcaatgttgggtttgacagtggaatcgatcgtatatttctggtgtccccaatcactatagtccatgaaatagatgaagacagtcctttatatgatttgagtaaacaggacattgacaacgcagactttgaaatcgtggtcatactggaaggcatggtggaagccactgccatgacgacacagtgccgtagctcttatctagcaaatgaaatcctgtggggccaccgctatgagcctgtgctctttgaagagaagcactactacaaagtggactattccaggttccacaaaacttacgaagtccccaacactcccctttgtagtgccagagacttagcagaaaagaaatatatcctctcaaatgcaaattcattttgctatgaaaatgaagttgccctcacaagcaaagaggaagacgacagtgaaaatggagttccagaaagcactagtacggacacgccccctgacatagaccttcacaaccaggcaagtgtacctctagagcccaggcccttacggcgagagtcggagatatga

SEQ ID NO: 23218 - DNA, 5021 bp, Homo sapiens
caggcaggtaaaggcagcttcttaggcagccagcgagttggcaggtgggttgggactcgcttgtcaactcattaattttaagcagtcagtttgggggtactgcaggataatcaggagggccgtggggagtcaagaggtgacccgggatgccggtggtggggaaagaaaagaggagcctctggaagcttggaggcaaaattgcgcttgggttcctgttccttgcatccctcctggcttgagtgcgggagaacactttttaaagactcaccttggaaagaaggcctccgtcccaggggagaaggagaggcgtctgcagggggcagagaccgcagctacctgccgggtgcgccccccacccaggagcgctcgcttcgccccctttcctcccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaatctcggcagacacctgagggtgagttccttccccttgaccaacttgaactggatgtaggttttagtacaggggcagatcaactttttcttgtgtcccccctcacaatttgccacgtgatcgatgccaaaagccccttttatgacctatcccagcgaagcatgcaaactgaacagttcgagattgtcgtcatcctagaaggcattgtggaaacaactgggatgacttgtcaagctcgaacatcatatactgaagatgaagttctttggggtcatcgtttttttcctgtaatttccttagaagagggattctttaaagttgattactcccagttccatgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacaagcatatttgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgcttaaaatatgtatgtctaattgagtctcttttttattctgttttcttgtttatggcatttgttgtaacaggatagactttttcctcacctaggaaacctatcccatgcctgtcacttatagttcaggaggaagtttttgcacagaccagagagaaattaaaattagatgataaattgaagatatcttacacacagttttttggtgaacactgattttattggtgtcttagatccctagtctacccaaataattttaacagtactgttttttctaatcctgaagtctgatatttatgactcattagcaggaatcaaaactagtgatcagtagaacactttcaaaataaaaatttggaatgcagacttttatgaaaatttaaaagtgctccttaacagaatatcatgggttttcctataaaacttctttaagtattgtaattccagtctgccccaactttaaaaaaaattcttattaatatgtcagtcattaattgctagtttgggctctcattatttcctgttttttaacaattttgtgataattttattattggcaaattaatacatcaacacttaaatcattgactataataataccttctggctacctctgtatcaaccaaattctgtaggtgcaaacatataccagggaattcttactggcaaaatgatcaatctggagtgtgcatccactgtgaatggagcaaattgccctatacccattgataacctagctttcttagtttgtagatgtaggaaacaaaatagtgacagagagagaagggggtccacagggcatggtatatttatcagcagtggaaaaaaagtgcatagatcatttagtccaagaacttaaaactaaatagagccataatttactttggagagtcattttaatttgtctttggtaccaaggagaagacggaaccaaaaacaaactctccaagtatattcacacattcaacaaaatttttgcatgccttctatgtcgtaggcatttttagttcctggggatttggacatggctaagtcagagaaggccattgctcaccatgaacactgtataccagaaggagagtggggaggagacaaaaaacaaataagaccacttcagacaatcaaagtatcagttaagagaatgaaaacaggcctgactcagtggctcacgcctgtaatcccagtactttgggaggcggaggttgggggatcacctgaggtcaggagatcgagaccagcctggacaacatggtgaaaacccgtctctactaaaaatacaaaaattaactgggcatggtggcaggcacctgtaatcccagctactggggaagctgaggcaggagaatcgtttgaacctgggaggcggaggttgcagtgagccaagattctgccactgcactccagcctgggtgacagtgcgagactccatctcaacatcaaaaaaaaaaaaaaaaaaaaaaaaaaaaaaaaaaaaaaaaagaataaaaacagggtaacataatgcaaagtaactgtgtggaataaaaattgattattttagaaaatgtgactggcttaggacggggataatatgtgaacagaaatctatctcatgagaaagtgctactgttgtcaaaattaccttatctgagtgaatggtattttttttatcttttccacacatgcgtgggaaaggtatgatttctgcatgtaattgcagtttaacccttatttctaggttgatcataggtcccagtttacccaggaaaattccagtttatacctgttgtacctgtgtaattattggtagcactccctttcactcttacaatgtcttggtttggatgatatatggtgaagtttttgttgaaactaaattatgaagtctgatatatttggataaaaataaagaattgcttttctt

SEQ ID NO: 23219 - DNA, 1095 bp, Homo sapiens
attggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaaggatgacttgtcaagctcgaacatcatatactgaagatgaagttctttggggtcatcgtttttttcctgtaatttccttagaagagggattctttaaagttgattactcccagttccatgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttccc

SEQ ID NO: 23220 - DNA, 2065 bp, Homo sapiens
gggagcggcgcgggacggccgggacgcgcggagaccccaagacccacgcgcagaccgagcggcagccggggaggggagcgcgggccggccggccgagttcgcgggcagggggcgccgggactcccctttccgcgcccgggacgccgcccgccggatcgcgccttgggatgtagcgcccgctcgccgcctcccggactctcgtcggaccctccgcccagcggccctgcgtcttcccaggtgaccacgccggcttcaggacatgcacggacacagccgcaacggccaggcccacgtgccccggcggaagcgccgcaaccgcttcgtcaagaagaacggccaatgcaacgtgtacttcgccaacctgagcaacaagtcgcagcgctacatggcggacatcttcaccacctgcgtggacacgcgctggcgctacatgctcatgatcttctccgcggccttccttgtctcctggctctttttcggcctcctcttctggtgtatcgccttcttccacggtgacctggaggccagcccaggggtgcctgcggcggggggcccggcggcgggtggtggcggagcagccccggtggcccccaagccctgcatcatgcacgtgaacggcttcctgggtgccttcctgttctcggtggagacgcagacgaccatcggctatgggttccggtgcgtgacagaggagtgcccgctggcagtcatcgctgtggtggtccagtccatcgtgggctgcgtcatcgactccttcatgattggcaccatcatggccaagatggcgcggcccaagaagcgggcgcagacgttgctgttcagccaccacgcggtcatttcggtgcgcgacggcaagctctgcctcatgtggcgcgtgggcaacctgcgcaagagccacattgtggaggcccacgtgcgggcccagctcatcaagccctacatgacccaggagggcgagtacctgcccctggaccagcgggacctcaacgtgggctatgacatcggcctggaccgcatcttcctggtgtcgcccatcatcattgtccacgagatcgacgaggacagcccgctttatggcatgggcaaggaggagctggagtcggaggactttgagatcgtggtcatcctggagggcatggtggaggccacggccatgaccacccaggcccgcagctcctacctggccagcgagatcctgtggggccaccgctttgagcctgtggtcttcgaggagaagagccactacaaggtggactactcacgttttcacaagacctacgaggtggccggcacgccctgctgctcggcccgggagctgcaggagagtaagatcaccgtgctgcccgccccaccgccccctcccagtgccttctgctacgagaacgagctggcccttatgagccaggaggaagaggagatggaggaggaggcagctgcggcggccgcggtggccgcaggcctgggcctggaggcgggttccaaggaggaggcgggcatcatccggatgctggagttcggcagccacctggacctggagcgcatgcaggcttccctcccgctggacaacatctcctaccgcagggagtctgccatctgacctccaggcccggccctcaccactgcccacaagagcctctgccgggggtgggatgccaggacaccccctcccacactcaggacagagccaaccctggctccgtggaccttctggaggaaggtgggggtttcaaagactgggggaccccttcctcctgactccagcacccaggcctgggaagagctcggccccgatcagcctgagttccgccagcgcctacttctggtggctctaggtccccggatccaccacccttcccccactgactcttcaaggacgtgccctctttgctctcagaaccttggggaaggtggctggactgctgggcgggggacatctcggggtttcagggtgggcagggggttagtttggggaggggggggtgcgtttcttttgcatgactgtggcctgttgctcatgactttcttttgtaaatatctataaatggagacagatggagacaccaaa

SEQ ID NO: 23221 - DNA, 1734 bp, Homo sapiens
gagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaaggccagaagctcatagaactttctgaagggagcaggtcatcagccttagcatgagccccggagcatcagtgtctgctggccgttgtgtgcatcccagctatggctggcgattctaggaatgccatgaaccaggacatggagattggagtcactccctgggaccccaagaagattccaaaacaggcccgcgattatgtccccattgccacagaccgtacgcgcctgctggccgagggcaagaagccacgccagcgctacatggagaagagtggcaagtgcaacgtgcaccacggcaacgtccaggagacctaccggtacctgagtgacctcttcaccaccctggtggacctcaagtggcgcttcaacttgctcgtcttcaccatggtttacactgtcacctggctgttcttcggcttcatttggtggctcattgcttatatccggggtgacctggaccatgttggcgaccaagagtggattccttgtgttgaaaacctcagtggcttcgtgtccgctttcctgttctccattgagaccgaaacaaccattgggtatggcttccgagtcatcacagagaagtgtccagaggggattatactcctcttggtccaggccatcctgggctccatcgtcaatgccttcatggtggggtgcatgtttgtcaagatcagccagcccaagaagagagcggagaccctcatgttttccaacaacgcagtcatctccatgcgggacgagaagctgtgcctcatgttccgggtgggcgacctccgcaactcccacatcgtggaggcctccatccgggccaagctcatcaagtcccggcagaccaaagagggggagttcatccccctgaaccagacagacatcaacgtgggctttgacacgggcgacgaccgcctcttccttgtgtctcctctgatcatctcccatgagatcaaccagaagagccctttctgggagatgtctcaggctcagctgcatcaggaagagtttgaagttgtggtcattctagaagggatggtggaagccacaggcatgacctgccaagcccggagctcctacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggctgagcagaatgaagaagatgagcccaaggggctgggtgggtccagggaggccaggggctcggtgtgaggggtgcagcctccctaagacctcctgtcactggcttcagtgaacacagacactgcagagcctgggagcaggggaggggaatagttgagtgtgctgtttgggggctcaggagccatcaaggc

SEQ ID NO: 23222 - DNA, 5940 bp, Homo sapiens
atttgtaccagggacggagggagagaggagagggaggaggggacacacacacacacacacacacacacacacacacacacacacacagagagagagagagagagagagagagagagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaacatcccagctatggctggcgattctaggaatgccatgaaccaggacatggagattggagtcactccctgggaccccaagaagattccaaaacaggcccgcgattatgtccccattgccacagaccgtacgcgcctgctggccgagggcaagaagccacgccagcgctacatggagaagagtggcaagtgcaacgtgcaccacggcaacgtccaggagacctaccggtacctgagtgacctcttcaccaccctggtggacctcaagtggcgcttcaacttgctcgtcttcaccatggtttacactgtcacctggctgttcttcggcttcatttggtggctcattgcttatatccggggtgacctggaccatgttggcgaccaagagtggattccttgtgttgaaaacctcagtggcttcgtgtccgctttcctgttctccattgagaccgaaacaaccattgggtatggcttccgagtcatcacagagaagtgtccagaggggattatactcctcttggtccaggccatcctgggctccatcgtcaatgccttcatggtggggtgcatgtttgtcaagatcagccagcccaagaagagagcggagaccctcatgttttccaacaacgcagtcatctccatgcgggacgagaagctgtgcctcatgttccgggtgggcgacctccgcaactcccacatcgtggaggcctccatccgggccaagctcatcaagtcccggcagaccaaagagggggagttcatccccctgaaccagacagacatcaacgtgggctttgacacgggcgacgaccgcctcttccttgtgtctcctctgatcatctcccatgagatcaaccagaagagccctttctgggagatgtctcaggctcagctgcatcaggaagagtttgaagttgtggtcattctagaagggatggtggaagccacaggcatgacctgccaagcccggagctcctacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggctgagcagaatgaagaagatgagcccaaggggctgggtgggtccagggaggccaggggctcggtgtgaggggtgcagcctccctaagacctcctgtcactggcttcagtgaacacagacactgcagagcctgggagcaggggaggggaatagttgagtgtgctgtttgggggctcaggagccatcaaggctgtggggaggaaccataaacccagccctcacagctcccagcacagggcctccctgagccagtggcatcctgcctgggccccccatggcagtgctgcctcttgtaggtgctggctaagggccaggccaggatgagtttccccatggtgaatgttaccggatggcatctgttctctccatgccctgggtcacttccttttttgggtctcacagacccctccaggggctgacacctagagagaaccatcaccttgtccctcattccttccaccctgaggcttgctgtggactcagagaggagacttacctgatgagagctcaaacctctagtctgggatgagctcacagagccctcatgagttaagatccatccatatcacataggcaattccttttaaatcagataccaacgacccattactgagaggtacagagcgtacagcccttggtgttctctgctgttatctgccaaatgtgtgtgtttttcctctgctgtgttctgtgtgtccagtgtagcctattggagaatcggtctcattagagtgactcttagaaggtggcctgggactagacagcccctctgagcacatgcatagtggcatcagcagcttcctggcctactcccaatcacactgtgccctgcacctcccaccaagggggaaccccagcagctggggcttttcgagtgctttttggcccaagaatctcagagtgcttctaatcatcacagtagtttttgtgttttgttttgttttgttttgttttgttttgttttgttttgtttttttcacaatctcagccagcctgcggtgtgacctggggagaaagttgagtgtcaggggacatgatgagccagttggccctgaaacaggaatggggcaaagagaaaggagagccaggagcatttaaaaatcagcatctgggccaggcaagatggctcacgcctgtgatcccagcattttgggaggccgaggcgggtggatcatgaggtcaggagatcgagaccatcctggctaacacggtgaaaccccgtctctactgaaaatacaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctcaaaaaaaaaaaaaacatcagcatctgccccagttgtggccaagacactctgacctcagggctcagcaccttcaccatcaagttcagcctgagccaagctcccagcccactgctgaaaagcccctgggcctccctccacaggcagagttacaaccgggagggctgggcagggagggcagggagattgcctggggaaggcaaagggaatggctgcccctcccaggctggaaacaagagggcaagcggggtcagcaggagaattcgggggcagggtgagtgttaagaaaaaaagagtagagaagagcctgaaaatcagcaacttccagggcttttctgatctggaggcccaagagcaagggtggaggggggcagattgtcaggtcccgaaatgtgtgttgacacacacgggcttcgggttagctggcctgacatggagatagagtgccaatgttcccaggccacagaattatggaggcctcacccacagtattcacagctctcaactggcctttgagaatggaagccttttcctgccctggatatggcgcttcttcctgggagaggagcagagccacagagaggtaggaagttgaggcagagcaaagggaaggcttcagagcttaggcccggttcatctcagaagtgttttctaggcctggggctgaaaggaagaggggtggggcagcctgggacgggaactgcctctgtgggctccccactcccagggaggggctccataagctttgctcctgggctggatcttgagaggtgggcagggtcttcccaccagtggcagggtgtgcagttgtggtcccaagccttggagggaatggggaatgggctggcacccggctcagggaaagcagaagcagacagtgccccagcaggggagctgcatgcccccaggagtctcagaaaggcagcccatcactaaggctggatgcctttcagcagagctacagctggagccctccggctgaggccagcactcgcctgggactccctggaccccagggttactaacagcaaaaccattccacacccccttgccagatctaagcctgtcttaggaccgtcagtgcccccaggttagagctcatgggggtcaactaagcgagggagggaaggcgaaggcaaagctggccttgcacctggacagcggcctggctcctccccacacctgccttcatttatgactctgaaacatcccccacctgaccaagggagccactctccagttctctcactccaccagggccctccgtgagccaggaccaggtcacatctctcagccaagtctagaagctctggctagaggagaggaagcgtgcagagggtcctctgccaaagctccctgcctggcccgagcccgggcatgctgggattagtgcaacaccgccccagtgtgcctcctctgccttctatcatgccagtttaaaagcaagaagactcccccttcacatcctgaggaaatccccttcctggtgaccaactgatgcaatgaaagtttgaaaagttcttcattttctagaagttcttgaataaacatggacttactaaatgcagagtctgatgatggacagagtttcaaggggtcactttcaaaacatttaattaatttatttatgtagagacagggtctcgctctgtcgcccaggctggagtgcagtggtacaacctcagctcactgcaacctctgccacctcccaggttcaagcgattctcatgcttcagcctcctgagtagctgggattacaggcatgagccaccacgcccagccattttcaaaacactgctcctgcatacaaaccactcagaggccactgcccttggttctgtgatggctctgagcccatgccatcacatctgatggaccccagagagctgagccgtggtttaagatggggtcatgcgctggtcattcccacagtcttgagtatctccaaaatcccaaagtgatatttcactttcggaccctgaaagtttggagagctggtttcttgccttaatttaagctctctgagaatgtcccctgtagggagaagcctccaggaactcagaatagaactcgttcccactcattttccttgctccaccaatctgacgcctgacagatgtcaccactgcctgaaggatcctgtccccaggccagggcagaatgggcattgcctttgactctccccttcagactcccctcccaccggcctcctgtgtagtcagagaacccactgcccatcgcctcctgctgctgctttgaggttgaggtcctggcttgagcagttaccttgctggagaagaggagcccctgccatctggggagcactgtccctgctcgtgatctgtaacagtggggcgctttttcacaccccttatctcacggcttgcttccagcccccatcaatcctgtgcctcatgtgaggtgagccccagagaaacttaaattgcttgtactgaagttgccaaaaaccaaaagttgcccgttgtcatttttaagactgtgccctgaacacacctctgcccatgcgccatggagcatgtgttaggtgcctgccgtgggtcaggcacttgattctcaaaacactgccgagaagctcttaccaacgtgacagttgaggctgagagaggttcatgagcttgctcaaggccacgggtagtaataagaggcatggccttggtgccaagtgcctcccaaacaaacagccggggccgtggtcctgcctaaactctcacatccacggcaccacgctgggcccaggcaacagagataaggagagccctggctcttgggatggggtcgcgccgattcacatgctgtgccacggagccccggcttccatccatgatgtgcccctgtggcgggataattgggaaacaacctttttctgattcccagagaactaatgagctgcaaaaagagattagacagggaagaattgctttcggggagaagccacttactcggctcgccttggtttttgctaa

SEQ ID NO: 23223 - DNA, 1350 bp, Homo sapiens
ggggtgggggtggccttccatcttgtgttctagtgaatcagaacagcccacttcactgatggtgtctttttaactcaaagcatcccagctatggctggcgattctaggaatgccatgaaccaggacatggagattggagtcactccctgggaccccaagaagattccaaaacaggcccgcgattatgtccccattgccacagaccgtacgcgcctgctggccgagggcaagaagccacgccagcgctacatggagaagagtggcaagtgcaacgtgcaccacggcaacgtccaggagacctaccggtacctgagtgacctcttcaccaccctggtggacctcaagtggcgcttcaacttgctcgtcttcaccatggtttacactgtcacctggctgttcttcggcttcatttggtggctcattgcttatatccggggtgacctggaccatgttggcgaccaagagtggattccttgtgttgaaaacctcagtggcttcgtgtccgctttcctgttctccattgagaccgaaacaaccattgggtatggcttccgagtcatcacagagaagtgtccagaggggattatactcctcttggtccaggccatcctgggctccatcgtcaatgccttcatggtggggtgcatgtttgtcaagatcagccagcccaagaagagagcggagaccctcatgttttccaacaacgcagtcatctccatgcgggacgagaagctgtgcctcatgttccgggtgggcgacctccgcaactcccacatcgtggaggcctccatccgggccaagctcatcaagtcccggcagaccaaagagggggagttcatccccctgaaccagacagacatcaacgtgggctttgacacgggcgacgaccgcctcttccttgtgtctcctctgatcatctcccatgagatcaaccagaagagccctttctgggagatgtctcaggctcagctgcatcaggaagagtttgaagttgtggtcattctagaagggatggtggaagccacaggcatgacctgccaagcccggagctcctacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggctgagcagaatgaagaagatgagcccaaggggctgggtgggtccagggaggccaggggctcggtgtga

SEQ ID NO: 23224 - DNA, 1325 bp, Homo sapiens
tttcaacattcatacagggaaaacaggaaaagcacaaagaagaaactgcaacaatggccaagctgacagaatccatgactaacgtcctggagggcgactccatggatcaggacgtcgaaagcccagtggccattcaccagccaaagttgcctaagcaggccagggatgacctgccaagacacatcagccgagatcggaccaaaaggaaaatccagaggtacgtgaggaaagacggaaagtgcaatgttcatcacggcaacgtgagggagacctatcgctacctgaccgatatcttcaccacattagtggacctgaagtggagattcaacctattgatttttgtcatggtttacacagtgacctggctcttttttggaatgatctggtggttgatcgcatacatacggggagacatggaccacatagaggacccctcctggactccttgtgttaccaacctcaacgggttcgtctctgcttttttattctcaatagagacagaaaccaccattggttatggctaccgggtcatcacagataaatgcccagagggaattattcttctcttaatccaatctgtgttggggtccattgtcaatgcattcatggtgggatgcatgtttgtaaaaatctctcaacccaagaagagggcagagaccctggtcttttccacccatgcagtgatctccatgcgggatgggaaactgtgcctgatgttccgggtaggggaccttaggaattcccacattgtggaggcttccatcagagccaagttgatcaaatccaaacagacctcggagggggagttcatcccgttgaaccagacggatatcaacgtagggtattacacgggggatgaccgtctgtttctggtgtcaccgctgatcattagccatgaaattaaccaacagagtcctttctgggagatctccaaagcccagctgcccaaagaggaactggaaattgtggtcatcctagaaggaatggtggaagccacagggatgacatgccaagctcgaagctcctacatcaccagtgagatcctgtggggttaccggttcacacctgtcctgaccctggaggacgggttctacgaagttgactacaacagcttccatgagacctatgagaccagcaccccatcccttagtgccaaagagctggccgagttagccagcagggcagagctgcccctgagttggtctgtatccagcaaactcaaccaacatgcagaactggagactgaagaggaagaaaagaacctcgaagagcaaacagaaagaaatggtgatgtggcaaacctggagaatgaatccaaagtttag

SEQ ID NO: 23225 - DNA, 2534 bp, Homo sapiens
ggagccgcgtcgcttcgtgcgctgccagcggggctcagccagtcggctggaattgagtagcattcattgaatctgcggatttcatgacgtctctctgcgtggtccaccacttttctcctaaccggggattttttttttcttctgccactcttatctttccccacttcattccacccagtctccctcccccgtccctgcccaaacgcgcgcccctccgcccctcccttggccccagcgcccagccctgctctccgcgctcggccagagggagccagtccggagacggccgcacctggctggagaggctgggcgggcggaggggtggagacccgcggacgccgggaagccggacctggagccggagcagccgcgagcagaatggagtctcctaacagcctctcggtgctgatgtgaaatttgaccatctgattccagtttttttcttttccttttcttttttgcatttccttccctcgccatccgtcgtgtagtgaattgttcagtcttgctccgtttcaagagaggagatcatgattgagtgaagccaccccgtccgcagccaggaaaagcacaaagaagaaactgcaacaatggccaagctgacagaatccatgactaacgtcctggagggcgactccatggatcaggacgtcgaaagcccagtggccattcaccagccaaagttgcctaagcaggccagggatgacctgccaagacacatcagccgagatcggaccaaaaggaaaatccagaggtacgtgaggaaagacggaaagtgcaatgttcatcacggcaacgtgagggagacctatcgctacctgaccgatatcttcaccacattagtggacctgaagtggagattcaacctattgatttttgtcatggtttacacagtgacctggctcttttttggaatgatctggtggttgatcgcatacatacggggagacatggaccacatagaggacccctcctggactccttgtgttaccaacctcaacgggttcgtctctgcttttttattctcaatagagacagaaaccaccattggttatggctaccgggtcatcacagataaatgcccagagggaattattcttctcttaatccaatctgtgttggggtccattgtcaatgcattcatggtgggatgcatgtttgtaaaaatctctcaacccaagaagagggcagagaccctggtcttttccacccatgcagtgatctccatgcgggatgggaaactgtgcctgatgttccgggtaggggaccttaggaattcccacattgtggaggcttccatcagagccaagttgatcaaatccaaacagacctcggagggggagttcatcccgttgaaccagacggatatcaacgtagggtattacacgggggatgaccgtctgtttctggtgtcaccgctgatcattagccatgaaattaaccaacagagtcctttctgggagatctccaaagcccagctgcccaaagaggaactggaaattgtggtcatcctagaaggaatggtggaagccacagggatgacatgccaagctcgaagctcctacatcaccagtgagatcctgtggggttaccggttcacacctgtcctgaccctggaggacgggttctacgaagttgactacaacagcttccatgagacctatgagaccagcaccccatcccttagtgccaaagagctggccgagttagccagcagggcagagctgcccctgagttggtctgtatccagcaaactcaaccaacatgcagaactggagactgaagaggaagaaaagaacctcgaagagcaaacagaaagaaatggtgatgtggcaaacctggagaatgaatccaaagtttagtgccctagctgggcaaacccttctcttctccccccaacacaatctttccttgtctctcattctctttctttttctgtctctcttgctttgttctttatttgtttatatttaatttttacatgaccagaaaacaaatcttcaaggtgtaaaatatctacctgccctctctcagttattcagattgacaaggtagacatggatttgatgaaagtgcaaagtgccctcatttgtggcccaagcctggtctcctcccaaaatactacacatccaactcctggagatttcagttacttacctgcatgtgttgtacaataccagatcactcaaaaaggtgtgtcaaagattttacctgggatatgacaagcaaggtttctggtgcctatttattcattcagtgagacacagagtggagccctcagttttatggatcccaattcatttcatctactacagggtgaggtgcttgcccccatgtgggtgtggcagttacagggcccaggtgagctgaagacaaaccactgtacatatatatgccttatgtaattattttctttttgtaattagtaataaaacccagcatgtacaaaagtaccatagaacagaactgctaaatactgtacatagatgtatcattaatgtaggtttagatatataactttagaaataagaagc

SEQ ID NO: 23226 - DNA, 2389 bp, Homo sapiens
cctcctccttccactgaagtggccaagggagttgagctgagcagggggaggggaagatctacacccatcccccttcctctagccctccctgcgtttagattcagttgcaccttttattattttaactcttctccttaggacacgcagcccccaatttgtccctccggcctgggcggcccctggtcccgcgcgccagcatgggagagcgagggacctgcccgcggcccgccggcgtgtgcaaggaggtccagccgccgcgcccgctacccggagtctgaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggtttggagtccactgtgtgtgtgactaatgtcaggtctttcacttctgcttttctcttctccattgaagttcaagttaccattgggtttggagggaggatgatgacagaggaatgccctttggccatcacggttttgattctccagaatattgtgggtttgatcatcaatgcagtcatgttaggctgcattttcatgaaaacagctcaggctcacagaagggcagaaactttgattttcagccgccatgctgtgattgccgtccgaaatggcaagctgtgcttcatgttccgagtgggtgacctgaggaaaagcatgatcattagtgcctctgtgcgcatccaggtggtcaagaaaacaactacacctgaaggggaggtggttcctattcaccaactggacattcctgttgataacccaatcgagagcaataacatttttctggtggcccctttgatcatctgccacgtgattgacaagcgcagtcccctgtatgacatctcagcaactgacctggccaaccaagacttggaggtcatagttattctggaaggagtggttgaaactactggcatcaccacacaagcacgaacctcctacattgctgaggagatccaatggggccaccgctttgtgtccattgtgactgaggaagaaggagtgtattctgtggattactccaaatttggcaacactgttaaagtagctgctccacggtgcagtgcccgagagctggatgagaaaccttccatccttattcagaccctccaaaagagtgaactgtctcatcaaaattctctgaggaagcgcaactccatgagaagaaacaattccatgaggaggaacaattctatccgaaggaacaattcttccctcatggtaccaaaggtgcaatttatgactccagaaggaaatcaaaacacatcggaatcatgacagcaagataaccccaagacagtcttttatcaagttttgacggtttatgctgggcactgccagactgaaccagagctggaacacaataatgtgtccttctacattttattacactaaatgatattcatattcaagcaacagcactttctgtagtaataaaaagtaacacaccaagtggaggattcatggcttatgcttgtttcatacatgtagaattcgcagtgatatacttaagttatgtgcaggggtgggtatgctcgtttctctcaatttgaaacacaagaattacactaatagtaacaggccttgagcacaaaatttggtcaagaaatgagtctgtttgaaatgcttagttggtgaaacccagatcgctgtgttactaatgatcactctggaaatgcaaatagaataggaggggaaaaaacaaaatcatgttaatgcgttttgtacatcagccttctcctgtctccatgataactgcatttggtaggaagcctgaggcaaaaactgcttaagtggatctgtttgtaagtggattcagttcattcgctttgtctgtcggtgactcctgaaggtttcctggtccatctcattgcggcctgttgggcagagctggacaaggtgtctttgaaggaaagctaagtcttgtctcatttaggactgggttccccacagtgacagtcacttccttcagcatctcacttcttcttctagaatccccacagggaaatactgtattgaatattttattaaaacattttctttgta

SEQ ID NO: 23227 - DNA, 507 bp, Homo sapiens
aagaagctgcaacatttcagaaagcaaccaattactgaggaccgaatgacctggccttatcagcgctgaagtgttaacggccgtccctgtttggggaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggt

SEQ ID NO: 23228 - DNA, 1586 bp, Homo sapiens
attattttaactcttctccttaggacacgcagcccgccggcgtgtgcaaggaggtccagccgccgcgcccgctacccggagtctgaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggtttggagtccactgtgtgtgtgactaatgtcaggtctttcacttctgcttttctcttctccattgaagttcaagttaccattgggtttggagggaggatgatgacagaggaatgccctttggccatcacggttttgattctccagaatattgtgggtttgatcatcaatgcagtcatgttaggctgcattttcatgaaaacagctcaggctcacagaagggcagaaactttgattttcagccgccatgctgtgattgccgtccgaaatggcaagctgtgcttcatgttccgagtgggtgacctgaggaaaagcatgatcattagtgcctctgtgcgcatccaggtggtcaagaaaacaactacacctgaaggggaggtggttcctattcaccaactggacattcctgttgataacccaatcgagagcaataacatttttctggtggcccctttgatcatctgccacgtgattgacaagcgcagtcccctgtatgacatctcagcaactgacctggccaaccaagacttggaggtcatagttattctggaaggagtggttgaaactactggcatcaccacacaagcacgaacctcctacattgctgaggagatccaatggggccaccgctttgtgtccattgtgactgaggaagaaggagtgtattctgtggattactccaaatttggcaacactgttaaagtagctgctccacggtgcagtgcccgagagctggatgagaaaccttccatccttattcagaccctccaaaagagtgaactgtctcatcaaaattctctgaggaagcgcaactccatgagaagaaacaattccatgaggaggaacaattctatccgaaggaacaattcttccctcatggtaccaaaggtgcaatttatgactccagaaggaaatcaaaacacatcggaatcatgacagcaagataaccccaagacagtcttttatcaagttttgacggtttatgctgggcactgccagactgaaccagagctggaacacaataatgtgtccttctacattttattacactaaatgatattcatattcaagcaacagcactttctgtagtaat

SEQ ID NO: 23229 - DNA, 2055 bp, Homo sapiens
gttcctggttctccagcaggaactgagagcaagggtcaggaggcgacaggtccaagtacagtagacactcaaagtgaaccctcagatatgaaagagccagatgaagaaaagaatgaccaacagggagaggcattggactcattgcagaagagaaagaacaagaaaaagaaaaagaagaggaaaaaatccccagtacccatagaaacccttaaagatgtttaaaaagagttaacttatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccagagaatcctaaaatgaagttggatggaaaacttgaccaagaaggcaatgatgtaaaaacagcagctgaggaggtactagctggtagagacacattagattttgaggatgtcacagttcaatcatcaggcccgagggctggtggtgaagaattagatgaaggtgttgcaaaagataatgctaaaatagctggtgccacttaaagcaatcctgaagaaccagagagcgaagatgcagatcactgcaccgtacccaaaaatgaaagtccctcacaggacattagtgatgcctgtgaagcagaaagtacagagaggtgtgggatgtcagaacatccaagtcagaccatcaggaaagctttagacagcaatagcctaaaaaaccatgacttgttggcaccaggaggagagccgggggacttcaatccagaaagcagagaagataccagaggagggaacgagaagggcaaaagcaaagaagaccgtaccatgtcctaagctgaggcaggcggcaggcgtggtgcacaggaagtctgagtgtgaggggctcttttctctccactgccaatgacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaagcgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaa

SEQ ID NO: 23230 - DNA, 1004 bp, Homo sapiens
acagtgcaaagagagagaagcagcttcggctgcagcaaaccacgcaggtccttcttgatcatctagaactgaccgctccgccttgccaggagtctgcagaaccacgtggctagcctgcctgaagttctcacctctccaggaaggcggggggcttctaatggctgcagctgcgctgggggctgggggctcccgctgggactccacttccgtggatgtctaagcttcacctttcttgcgcccgcaggggcatgactcaggtgaaagggagccattttctcagacccctggcctcatgcagcccttcagcatccccgtgcaaatcacacttcagggcagccggaggcgccaggggaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagcgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaatgcagtataccacag

SEQ ID NO: 23231 - DNA, 1485 bp, Homo sapiens
tgccctgcgagaatgtatctcatcctttgctggagcaggtttgcaggcacagtggagagaggagagaagaaatgaagggacacttatgcagaaccatgagtggccagagaggaggagaaggagggtgagaggagcaaagaagccatgacaacttcataattctgagtggactgggcagtggccagaaattctggtggtggatatgctgcctttccaacaggtgaatatgaaagaataagtcaaaccctgttcaggacgctgttaattccaaatgtgaactttttgagtcattctttccatgtggaattcaaaggagaatgtaaacaaattttcaggagggacgtgcaatatccctgaaagataacaaagttcgtaacacttatttacatacaacattctctagttattgattaaacagatctctacagacttgcatgaggcaacatttcttaggcttgtttgctacaatatctttaaaaatacttgattacacatcactttagcttatttagatggacttttcaccaagctctgaactgggatttcattttgttgcattcatcctgctcacgagacacaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaa

SEQ ID NO: 23232 - DNA, 1228 bp, Homo sapiens
gcagcaaaccacgcaggtccttcttgatcatctagaactgaccgctccgccttgccaggagtctgcagaaccacgtggctagcctgcctgaagttctcacctctccaggaaggcggggggcttctaatggctgcagctgcgctgggggctgggggctcccgctgggactccacttccgtggatgtctaagcttcacctttcttgcgcccgcaggggcatgactcaggtgaaagggagccattttctcagacccctggcctcatgcagcccttcagcatccccgtgcaaatcacacttcagggcagccggaggcgccaggggaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaa

SEQ ID NO: 23233 - DNA, 1608 bp, Homo sapiens
gttcaccagacaccctgccctgcgagaatgtatctcatcctttgctggagcaggtttgcaggcacagtggagagaggagagaagaaatgaagggacacttatgcagaaccatgagtggccagagaggaggagaaggagggtgagaggagcaaagaagccatgacaacttcataattctgagtggactgggcagtggccagaaattctggtggtggatatgctgcctttccaacaggtgaatatgaaagaataagtcaaaccctgttcaggacgctgttaattccaaatgtgaactttttgagtcattctttccatgtggaattcaaaggagaatgtaaacaaattttcaggagggacgtgcaatatccctgaaagataacaaagttcgtaacacttatttacatacaacattctctagttattgattaaacagatctctacagacttgcatgaggcaacatttcttaggcttgtttgctacaatatctttaaaaatacttgattacacatcactttagcttatttagatggacttttcaccaagctctgaactgggatttcattttgttgcattcatcctgctcacgagacacaggtaggcagcaaatgagattatccctccagtccccatggattggaaatgttcccccttctttatgagctcactgcagtatctccttctccctttccccaaaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaatttaaaa

SEQ ID NO: 23234 - DNA, 1159 bp, Homo sapiens
tacagagaggtgtgggatgtcagaacatccaagtcagaccatcaggaaagctttagacagcaatagcctaaaaaaccatgacttgttggcaccaggaggagagccgggggacttcaatccagaaagcagagaagataccagaggagggaacgagaagggcaaaagcaaagaagaccgtaccatgtcctaagctgaggcaggcggcaggcgtggtgcacaggaagtctgagtgtgaggggctcttttctctccactgccaatgacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgg

SEQ ID NO: 23235 - DNA, 6875 bp, Homo sapiens
ccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaat

SEQ ID NO: 23236 - DNA, 6018 bp, Homo sapiens
agcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaat

SEQ ID NO: 23237 - DNA, 3720 bp, Homo sapiens
atggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcgttgggaagaacattgttctttgtggagactggaaagcaagggaaatgtgagaagattaaactactgcaggggtcagcaaactttctctgtcaaagtcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttga

SEQ ID NO: 23238 - DNA, 3690 bp, Homo sapiens
cttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagcagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 23239 - DNA, 3646 bp, Homo sapiens
cccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 23240 - DNA, 3774 bp, Homo sapiens
cggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 23241 - DNA, 3788 bp, Homo sapiens
atggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 23242 - DNA, 4157 bp, Homo sapiens
ggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 23243 - DNA, 4617 bp, Homo sapiens
gcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagctaaaccgggcaagttgcctttggtatcagtcaatcaggaaaaaaacagtgggacgcacattctaatgataactgaactggtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaacagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 23244 - DNA, 3820 bp, Homo sapiens
cccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaatgcaacaaggatgaatagaatgggccaagaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 23245 - DNA, 3660 bp, Homo sapiens
atggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctggtcacaggctggatgccgtatctgggacctagggttttaatgacttgcctggatattggtgtagtatgcatgccaactgatattcaatcaacatctcctgccagcataaaaaagtttaaggagactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttga

SEQ ID NO: 23246 - DNA, 3723 bp, Homo sapiens
atggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtggcaggctcagtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttga

SEQ ID NO: 23247 - DNA, 3761 bp, Homo sapiens
agctgaagaggggagagagacaccctccccacccccatatgaggatggtctgtgatgatatgcatgcaggggaagggacttatccaaggtccctgatagatagggactggaattttggcagtgtcttttctagagtagaacaaatttatcagttgaatttgctgtagttctctgaaggtttctttggccacattagaatttttgagccctggcatccaagtaggccaacttcaaaatggctgtgtgctccactcagagattctgctgtgaagactggcaggagattttttagcctattctgaactccaactgttccagttcctcttgctttccagaggtgtgagcacctggaagcccctgctctggtctacaccccaggctcaagattcatcctgctcactcagccactcatgctgtcaccagtgataaaactgagatgcattccccagaaccaagcaaacaagaagaaggtcctccttcagtgggctgtcatcgatcattccccgttccatggccacaggactgactgctgatgaaatctaaaagaccagcttgcagaaggcatggaaatcctggggttaggggcccctctgctatggaggttgtcttagtctttgctctcagcatcggtgcacttgtaatatacttcatagattcatcaaactcctggagacttcatggcaaaccaacatattgaatgcaggaaattccagggtggccaagaatattctccagaaatcccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttga

SEQ ID NO: 23248 - DNA, 826 bp, Homo sapiens
cgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagacctcctcaactctgtctccctttggctgcccagaaaaggtgctttcagagtgacaagcttgatatttttatttgactgagaaacgacatacttctgccccctcaaatatatatttgaccagactgtgggaattttggtgttgtatttaacttccccaccaagggcccagggctcattgcccacatgtccccacgagtagcatcaaaggctgttctcaaaaatgaaagacgaatgagcagacacagtgtgtcacatcagcaacttttttcccagtttctttgtaaatggaagtttatgaaaaggagcactaactcaaatcacagaatcctgtgtttgaaataaatggtcttgcaacaaac

SEQ ID NO: 23249 - DNA, 3090 bp, Homo sapiens
gaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtcttccttcacttcccccattgccaccccccaatcccagtccccccatcggtctgttcacatctctgtgttcatcttggcaagacctactcaatcaagtgatgatgccagttgataaacttccctggaaaacatttacagctattccatttggcaaacttgcttctctgtcaatatttcatcctcctttaaaccaggagggttattaatggcaaaagcattggtcttctttatgcttgatcagtatgactcaaattaaaagtgttctgctgtgtatatcaactcagtagcccacacccagttatctgggagctgatggttcagtcactgtattacccaaatctttcctgccagctgcctttcagacatttgttaaatcccaaccagagaccgggcagatagagagaagtaaatccgaagtgcgtttt

SEQ ID NO: 23250 - DNA, 994 bp, Homo sapiens
agtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctggccggttctcaggatactcatcctgacagcttctaccaccaggcagtgaatgcttcctcttacctccatggtggagggcagatgtggccagttagctcctcatcttccatcctcctccactatctcaggcgacagatgccagggccagcccgccttccacttgagctttcttgtcaaggctctgccttgagcccaaatcctgacctttactgtatgaaataaagtactgatgaacaagcagaggtttgaattagagcaggcttggagcaaatgtcaagtccgtctctgcctctttcctccacctgcaccaggagcctcgattagacccagtgtggagtttgcagcgccttaggctttatgggtctggggagacataacttattaacaaagagttattaaatttttatcaattttacaacacaa

SEQ ID NO: 23251 - DNA, 3902 bp, Homo sapiens
agcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttc

SEQ ID NO: 23252 - DNA, 1559 bp, Homo sapiens
agaatcatttcctatttctggcatctttgccagcccacagagacagagagaagaagaaatatttccaaatataccaggctgatctttcgtagtttctcagtcttgctgtctgttgttgtttgaaatctgtttcccacgagactctgggaagatggaggtgcagggcttgggtaacagctgccttcctcagggctgggtacctgctctccgagtctgtgtctccaggctgtgtgctcagacttgaccatgtttgggcatggaggcttgccccagatggggaccaaaagctgcttccctggagacgggcggggaggccaaacttcctgctgaagctctgtggcctcttttggggtgggggcgggggtccaggcagaaagaaactgtctgctgctcaagacccacaggacgccgggaagactaaatgatcactgcccccagtgaatatggtgaagaagctggtgatggcccagaagcggggagagacacgagccctttgcctgggtgtaaccatggtggtgtgtgccgtcatcacctactacatcctggtcacgactgtgctgcccctctaccagaaaagcgtgtggacccaggaatccaagtgccacctgattgagaccaacatcagggaccaggaggagctgaagggcaagaaggtgccccagtacccatgcctgtgggtcaacgtgtcagctgccggcaggtgggctgtgctgtaccacacggaggacactcgggaccagaaccagcagtgctcctacatcccaggcagcgtggacaattaccagacggcccgggccgacgtggagaaggtcagagccaaattccaagagcagcaggtcttctactgcttctccgcacctcgggggaacgaaaccagcgtcctattccagcgcctctacgggccccaggccctcctcttctccctcttctggcccaccttcctgctgaccggtggcctcctcattatcgccatggtgaagagcaaccagtacctgtccatcctggcggcccagaagtagagccatccatccatgccataccacttgtcagggcacaggggactggctgggcccccagggctgctccccacttgcagcacaatgccttctccacctgccctcccactcttccagtccaatccacgctgtcttctgttgcaggactaacctttgagaaatccttttgtgaagtcattgcctgctcaagaatgtacagtggctccccaatgccttggaggccataaggccagccagttctagctctctattacctgtccccactcaactgactcatacctgtttccggctgcatcactatgtgccccacagagaacgatgatcgtcacctctgtgcctgagttctccctgttgtctcaaagcggtacccatcctcccccagaagctgtccccagcgagcctcccttctttgtttgaattctctaataagagcaacagcagctcccatttctagaacacatttacagtattactattttctaggatataaagtgccatatatatttttaattccaatattaataaatgtatgccaaacaacaa

SEQ ID NO: 23253 - DNA, 1733 bp, Homo sapiens
cagagagaagaagaaatatttccaaatataccaggctgatctttcgtagtttctcagtcttgctgtctgttgttgtttgaaatctgtttcccacgagactctgggaagatggaggtgcagggcttgggtaacagctgccttcctcagggctgggtacctgctctccgagtctgtgtctccaggctgtgtgctcagacttgaccatgtttgggcatggaggcttgccccagatggggaccaaaagctgcttccctggagacgggcggggaggccaaacttcctgctgaagctctgtggcctcttttggggtgggggcgggggtccaggcagaaagaaactgtctgctgctcaagacccacaggacgccgggaagactaaatgatcactgcccccagtgaatatggtgaagaagctggtgatggcccagaagcggggagagacacgagccctttgcctgggtgtaaccatggtggtgtgtgccgtcatcacctactacatcctggtcacgactgtgctgcccctctaccagaaaagcgtgtggacccaggaatccaagtgccacctgattgagaccaacatcagggaccaggaggagctgaagggcaagaaggtgccccagtacccatgcctgtgggtcaacgtgtcagctgccggcaggtgggctgtgctgtaccacacggaggacactcgggaccagaaccagcaggtactgaactggagggatggggacacatccctttatccctgtcaggtgtgtgagcctgttcctaactgtccctgtccccgaggctgagaaagatcaacccacttgaccaggtctcacagctggaatgagactgagccagccctagctcttctgtgttggagtcacacagacctgggtttgaatctgccgctaactggctgtgtaaacataggcaggccacttagcctctcacctcctcagtttccacccttgtaaagtggaatgctaatgctgcaccttgaagagctgttatcaagtcagagacgctgtatataaagtgccacgcttgatgctgagtggatagtgggcactcaaacaaaagcagtgattagtgttagtactttcattctacaacctcagtcaaatgagggaccaggcccagggccagatcctcaaagtggaatcccggtgactccccaggaaaccagggactcagggctggagtaacctccataaacaaacatttagatggtttttccatccttgcatcccaacatcccaccctccccctccaaaacacaaaactcaccaccatatcctttcctaaagcgatcagttggcccatattctgtctctcttccttccttctttctttccttcttttttccctttcttccctccttctttcttttcttttttttcccctccctccttccctccctctctccctcccttccttccttccttccttccttccttgtttccttctttcctcctctcatttatttattcaacagccattgagcacctcctgtgtcaagcctgtaggactcaagaggagagagctcatgcatgaacagtgcctagcagggaagaattggcaccggggagaagaacagaggaagttacaggggttagaggagggggatgttttccagctgacaatgatgggggtatcagaaaggctcttggtgagattgcaccattgcactccagcctggcaacaagagtgaaactccatctcaaaaaaaaaaaaaaaaaaaagaaa

SEQ ID NO: 23254 - DNA, 4731 bp, Homo sapiens
gctcgccccagctcagacactcctagccttggggcagctgccgggcgagtcagcggagtagcggccagcgggcgatggagacagagagacacccgacgagaggaggcggggtgggggaggcggggagagtgcgggggcggaggctggcagggggcgctggaagctggagcggtccgtgcgctccccgcgcccgagggtgcaggaggctctgaagcggctgctgcaccgcggggcccaggcggcggctggggggctggggggcgctgccgccgccgccgccgggggcgtcgctggcctcggcccctttgttctcgcgcgctccccctcgccgcccactcccctgctgtcgcgcggcggcggcggtggcggcggcggctcctcccgcccgaggcagtcgggctcggcgccgggggcgggagggggcggggggagcacgccagccgccgagagtggggggcgatggcgaagctccgggtggcttacgagtacacggaagccgaggacaagagcatccggctcggcttgtttctcatcatctccggcgtcgtgtcgctcttcatcttcggcttctgctggctgagtcccgcgctgcaggatctgcaagccacggaggccaattgcacggtgctgtcggtgcagcagatcggcgaggtgttcgagtgcaccttcacctgtggcgccgactgcaggggcacctcgcagtacccctgcgtccaggtctacgtgaacaactctgagtccaactctagggcgctgctgcacagcgacgagcaccagctcctgaccaaccccaagtgctcctatatccctccctgtaagagagaaaatcagaagaatttggaaagtgtcatgaattggcaacagtactggaaagatgagattggttcccagccatttacttgctattttaatcaacatcaaagaccagatgatgtgcttctgcatcgcactcatgatgagattgtcctcctgcattgcttcctctggcccctggtgacatttgtggtgggcgttctcattgtggtcctgaccatctgtgccaagagcttggcggtcaaggcggaagccatgaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgttattttctatttccttttttatgcttagaacaccagggtttaaaaaaaaaaaaaaggtgaggacatctgggtctcatttgcttctgctaggttaaacttttacttgacaacaaggattcctgctgaagtctgaaccttactgtgtaaccctcagtttccactattaaagagtatcttttgacgtctgcttggaaaatgaatagtatactggtaactcagtctccagtcacctctgtgtctcttaagcaagagattctaaaagattgggaaaacatatcctccaacacctgcctttgcctaaccattatttttcaccagattacttcttaagagagggaggtgattctgaagaaggcttctatctcaaaaagcactgggcttccttattcatctgttcttgttgtttttgacggagttaaaaaagtttgtgtgcaatacaatatacatgatgtgaaggacactcttcagcttagtgaaacgctgttttcatttttttttttttttgtaggtcagaaaaaaacaacaaaatcagttcaagcatttttttttctttgtccttgccttgatgttatgagtattaaaaccaggaggattgctgccattgtgcagtttgcttagacaaacctggagatgcaacccagctcacatcattgctactgatgagctttctgtgcctttatcaaaagttgattgagaagaccatatttctttgtatctttttataaactcaaattccaagtatcaaatcgcaggtctcagtgaacatcaaacctatttactacatagaatcaaacctttgtttaggtgagatgtacatcgttagtggaggaaaaactgacaacctaatttcatttgttttcttctgatactcttcagacatgcctctattagaataaaggtaaactggaatttaaagacaagttcccctcagttatttccatggagctgtaatatgtatatatggagtgatggtttcctgacctttagtccacataccaatgttttcttttttcttttttttttttttttttgagatggtgtctcactctgttgccaggctggagtgcagtggcacgatctcggctcactacagtctccacctcctgggttcaagtcattcctctgcctcagcctcccgagtagctgggactacaggcacgcaccaccacgcctggctaatttttttgtatttttagtagagacggggtttcaccgtgttagccaggatggtctcaatctcctgaccttgtgatctgcccacttcacctcccaaagtgctgggattacaggccaatgttttcttaatcttagaatgtgaataactgaaaatcatagtctgtggaaaggtgttgaattgagtataatcttcttctgtttatttttgtgttttgttttttaacagatgggtatcttgctatgttgcccaggatggagtgcagtagctattcacaggtatgatcatagcacactgcagcctcaagctcctgggctcaagcgatccccctccctcagcctcccaagtatctggggttactggtgtgcaccaccgtgcttggctccaataattttttttctaattcaaaagttacagtttcactgtgaaaaaggccttgaacacactatttatgacatcttttgaggcagctccagtgccttgacttcaatcccagtttccggttgcagcatccttgttgtcttagcaacacagtgaactattctgaagcatagagtaacacgaaactgggagtccgagaaataatcatctctgcatcacattatgggagacgaagtctgctttatccattttatctttattcagttgtctatgattaattgattacagagtagtagattagaatagtgcatggatatacatttgtgttgaaaaaaggggaagttgatatatatcaatcttagttttcatttatcagtttgatattcatgcatttacactaaacgcttccatttatcccgaaaaagtatatgcaactgtattctgtaggttgatttttggaaaaggggagaagcacactgaattcataaggtcacatgtagtcttaaggtcttacttgcttacagccaattaaatttgaagcaccttatttatacttgttaaaggtaaaacccaaaagaacaagcagaggacattttaaggtcataaaaggtaaataagcttaccttcttaatgttttcattctctttttgtataaatcagaaaatgatctaaactgctgtaacaaagagaccccaaaatatgatggctcatgtaagataatttatttttttctcacatagcaatccagaagtggcttcatttcacaaggtattcaagggatataggagtcatctaccttgttagttctcttaatacccaagggtattgttctttccatggtcaaagctggctcaagacttcctagcctgtgaaaaaagaagaaggtggagcaagccatttcctttttaggaaattacagccatcacttctgcccaccgtccattcatgaatacttactatatagctatacctagcttcaagaaagcctgggacgtgtctctaactagatggacatgtgccctactaaaactccagggaaagggttctattactaaagctaaaaagaggggaatgaatactagagttaaagacaaaaatgatagcagccaatggcccatgccgtgataatctgctgagcaggcatgatggagatcccttgcccagcagaaagtgttccttggtgaaatcatgaatctgctatctaggagaaactcccttgtccattgtcttctgtggccactagtttgacctctaggaaagtcttgctcgtcagcttctgtggccccgtctgaaacttttgagggacatcgcagcttttgcagcccctgcttgctggtgcagacttttagacctagattgccttagagactgaaaaatatacgcttttataggccggggttttagttcatttgactgtaataaagacgtcaatgccgtttttaatgtttgactgctgacatctttcaagactcacctttcccttctcccttatgctgcacatctgggcaagctgatggaagcatgggtgcctcctcctttggccccagcaggaagttcaaatcacgcaagccctggcatgcatgcaggaagcttcaccccagcctcacactctaagacggataaaagccaaaccaattaagccgtttctcgaccctcctgggagcctgccctatctccctggaaagtctcagtatgtgagtaataaacctttttataccca

SEQ ID NO: 23255 - DNA, 2576 bp, Homo sapiens
acttgttaaaaatcttgttcttgcattcattaccttatgaagcctgcagaacacgccacgatgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggatacacatttatctgctgttcttacttttaa

SEQ ID NO: 23256 - DNA, 5219 bp, Homo sapiens
cacggggcgaatgcggcgcgggttcctgcctctctgggtgggtgaggggcgcgcggatccggagagggggctccgggagcggcgggaccacgcagccacctgtgagccttcggcagctgcgggcggcggcggcgtacccggcccgagacgggaggagacgctcggcggcccccgcccgccggcccgccgggcgcacacactcgcacccgcgcacgcaccgccagcaggcagcggccaccgccgcgatgctcgcccgcgggttggggaagtttcccgccggcctcggccgcgggcacccgtgctcccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctggagctctgcgatgactacgacgacgtccagcgggagttctacttcgaccgcaaccctgagctcttcccctacgtgctgcatttctatcacaccggcaagcttcacgtcatggctgagctatgtgtcttctccttcagccaggagatcgagtactggggcatcaacgagttcttcattgactcctgctgcagctacagctaccatggccgcaaagtagagcccgagcaggagaagtgggacgagcagagtgaccaggagagcaccacgtcttccttcgatgagatccttgccttctacaacgacgcctccaagttcgatgggcagcccctcggcaacttccgcaggcagctgtggctggcgctggacaaccccggctactcagtgctgagcagggtcttcagcatcctgtccatcctggtggtgatggggtccatcatcaccatgtgcctcaatagcctgcccgatttccaaatccctgacagccagggcaaccctggcgaggaccctaggttcgaaatcgtggagcactttggcattgcctggttcacatttgagctggtggccaggtttgctgtggcccctgacttcctcaagttcttcaagaatgccctaaaccttattgacctcatgtccatcgtccccttttacatcactctggtggtgaacctggtggtggagagcacacctactttagccaacttgggcagggtggcccaggtcctgaggctgatgcggatcttccgcatcttaaagctggccaggcactccactggcctccgctccctgggggccactttgaaatacagctacaaagaagtagggctgctcttgctctacctctccgtggggatttccatcttctccgtggtggcctacaccattgaaaaggaggagaacgagggcctggccaccatccctgcctgctggtggtgggctaccgtcagtatgaccacagtggggtacggggatgtggtcccagggaccacggcaggaaagctgactgcctctgcctgcatcttggcaggcatcctcgtggtggtcctgcccatcaccttgatcttcaataagttctcccacttttaccggcgccaaaagcaacttgagagtgccatgcgcagctgtgactttggagatggaatgaaggaggtcccttcggtcaatttaagggactattatgcccataaagttaaatcccttatggcaagcctgacgaacatgagcaggagctcaccaagtgaactcagtttaaatgattccctacgttagccgggaggacttgtcaccctccaccccacattgctgagctgcctcttgtgcctctggcacagcccaggcaccttatggttatggtgtaaggagtatgcccagcccctgaggggagagatgcatgggatatgcacccaggtttcttttacagtttttagaatcgtttttagagggtggtgtgtctgacaccatgcctttgcacctttccatgaaatgacactcactggtctttgcatcgtgggcataaaatgttcacctttttgccagatgagtacacccagaatgctaatttttctgtccatcgtgtacgctattctagtgcttgtggcccagtactgtctatgagttgtcgtgctcctgtttctgaggttgtcgtgtgagttctgtacaaaaagcccccacaagtcgtccagtagaaatgcatctatgaggtcagcaaggatatgatgagattttgctcacagtcatgtgaaaacaaaatctcagctctttatccattgctttcacttagttttagtaccaaaacaaagagaatgcaaagttaagcagacttgaccaatgcaagtctctaagttgtttttataaatgatctgtagttccgtggcttgcatgggtgcaccaatcatctttagaacgatgtacactgatgttcatctcataaatgtcactctttagagaatgttacttagttaaacatgcagtgaagatcgaatttttttcccaagaacagatgtgttagggagaggggcttcagctaaatagtccaaaccctagggtgcttaaagccaagttagtgcaggctgagccccttggttcacagtcaagcctccttgtttcctagggtgactgtagagaaatgtatttccggatgaggtttctgatctaggccatttgaccaaactttgctgtgtctaagatattagcatgtttttgaaatatttattttttaagatgtttaggagtaaggtcgtgttgtcttcctcaactaaaaagaagtttactgttgtatcgtctccctgaggtgaacgttgttgggttgctagcaagggcagtagcttaaatacttttgttgcctactctgaaagctcatcaaatgagagcccttttatttccaagcagaatttagtcagataattttgcttctaggatatagtatgttgtatatgatgctgtgattgccctggagttcctgccatgacatggaaacctggtggtatggaagcatgtactcaaaatatagacgtgcacgatggtggtgtggcttacccaggatggaaacactgcagttcttacttgcattcccactgcctttcatggggggtgactgggtagaggccaggagaaaggaaagagttgtaaaataaaaaactgctagttcataaaatgtcataaaaaattgtaaacttgaaaagcttaatgctattcaaaagaccttcaagcttccaaacttgtattgaagggagacgactgtttcctcctccaaaatgctcctgctcctcttgttcggttaaccagcacataacattgtgatggggaacctgggttcctctataagataattcttctccatcatctttaaggtaatctgatggttttccaggtggctttcattattgttccatctttgaaaaggcaatagaacccaggggtctgagcatggagctatccagggttttcatccaaaggttgggcctcttcttaagaggtccttttgtgtttcagttgattgaagatgatacttacctcattggaggtgtggcaaggatcttatcagaaggctttgtgttcttgtagttgtcatggctactacagtgtgggtgatttattgaatgaattcactagccacttgtgtcctggagcccccagttcaaatctttccattggactggaggcttgtgggaggctgggaggtggctgtctcctagtgtctacatccgtgtctctgaagcatcaggaaaagtgagatgacttagaggcaactgggcactgaatcagaggagcagagttatttttcagaatttgcacatggaacacttagatttggctggtgcttccagccctggaaggcataacatttacggactcatccccagctgcactgaaggcaggtggtggtacagacttatgaggacggatcagtttgccaaggctgatggtattgggtcactgagcctggtatccatggccgctgaccaggaagcttatgcaaagtggaagcaaggaacaaggcagaataactcagtcactttcatgaagatttttctaaacaagaaggcttaccaccaaaaaagaggtaccctagtggttaccctttgcagatgtgaaagctggaaaacttgacttttctttttggtaatgacttgcatttatctggtgcctttcgttggaggaatcccaacgtgctttagagactatctttttaacatctcttgtacatacatatatacttatataaaatattatcttgcccaactggacctttactcacttctgagcatgagaatgtcccaatagcattgagtttttcaagtggtggtttcagataagtgggagaaagaacaacccggctggcttaaaccctggagctaattcccacaaggaatgtagactgaatggtgacccagggagaaataatcttcctctcccctaaagtctcactaaggtttgaagtttacaggtgctctccactgggtctttgatcgaccttgctagataacatctaaccagcagtttcttttagtccctgaagctaaccagggagagtcaggttaattttctgtaaaaatatgaggtgacatctttggcaaccaggctgtcagactgacctgtaaacctcctttagggggacagagtagaaactggagatgacttgtttccagctgtgagcttgagagaagtgtcactcccagcatttgaaggttattgttttcaatgccagtgggccaaatatatgggccaggctttgatatctgtgatgtgcattttggaagtgctgggttgggaagtgacacgtctgttgcacaaatgcatattggttataggtttgtgttttctgccaaacccccacatttctcgggtttgtgagtgaggaagggcatgttgtaatgccaagctgatttgtagctcgtaaggtagtaattggtatttaacatttgcatttgttatttctacttatcttagcactcaaataattgaactacctgctaattcttgccgcatttcaaagaaaataagttgttatgcactttgggatagtggtgatctgtacaggctgtgtgttagctacttgaaggcgtaactggtatttcttgtgtgttttaacagcatgacttcttacagagctgtaatttttaaaattgaggatgccatatttgagatgtcagttttaacactcattaacacactactgtgcaagcattgacacaggctgcactg

SEQ ID NO: 23257 - DNA, 4340 bp, Homo sapiens
tcccccccaccccaccaaagctacgcgccccccgtgtcggcccggccctgcccgtgcgtatctcagctccggtcccgcctgtctgcggcgagcgggcgggggcgtctcccgggcctgcccatggacaaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctggagctctgcgatgactacgacgacgtccagcgggagttctacttcgaccgcaaccctgagctcttcccctacgtgctgcatttctatcacaccggcaagcttcacgtcatggctgagctatgtgtcttctccttcagccaggagatcgagtactggggcatcaacgagttcttcattgactcctgctgcagctacagctaccatggccgcaaagtagagcccgagcaggagaagtgggacgagcagagtgaccaggagagcaccacgtcttccttcgatgagatccttgccttctacaacgacgcctccaagttcgatgggcagcccctcggcaacttccgcaggcagctgtggctggcgctggacaaccccggctactcagtgctgagcagggtcttcagcatcctgtccatcctggtggtgatggggtccatcatcaccatgtgcctcaatagcctgcccgatttccaaatccctgacagccagggcaaccctggcgaggaccctaggttcgaaatcgtggagcactttggcattgcctggttcacatttgagctggtggccaggtttgctgtggcccctgacttcctcaagttcttcaagaatgccctaaaccttattgacctcatgtccatcgtccccttttacatcactctggtggtgaacctggtggtggagagcacacctactttagccaacttgggcagggtggcccaggtcctgaggctgatgcggatcttccgcatcttaaagctggccaggcactccactggcctccgctccctgggggccactttgaaatacagctacaaagaagtagggctgctcttgctctacctctccgtggggatttccatcttctccgtggtggcctacaccattgaaaaggaggagaacgagggcctggccaccatccctgcctgctggtggtgggctaccgtcagtatgaccacagtggggtacggggatgtggtcccagggaccacggcaggaaagctgactgcctctgcctgcatcttggcaggcatcctcgtggtggtcctgcccatcaccttgatcttcaataagttctcccacttttaccggcgccaaaagcaacttgagagtgccatgcgcagctgtgactttggagatggaatgaaggaggtcccttcggtcaatttaagggactattatgcccataaagttaaatcccttatggcaagcctgacgaacatgagcaggagctcaccaagtgaactcagtttaaatgattccctacgttagccgggaggacttgtcaccctccaccccacattgctgagctgcctcttgtgcctctggcacagcccaggcaccttatggttatggtgtaaggagtatgcccagcccctgaggggagagatgcatgggatatgcacccaggtttcttttacagtttttagaatcgtttttagagggtggtgtgtctgacaccatgcctttgcacctttccatgaaatgacactcactggtctttgcatcgtgggcataaaatgttcacctttttgccagatgagtacacccagaatgctaatttttctgtccatcgtgtacgctattctagtgcttgtggcccagtactgtctatgagttgtcgtgctcctgtttctgaggttgtcgtgtgagttctgtacaaaaagcccccacaagtcgtccagtagaaatgcatctatgaggtcagcaaggatatgatgagattttgctcacagtcatgtgaaaacaaaatctcagctctttatccattgctttcacttagttttagtaccaaaacaaagagaatgcaaagttaagcagacttgaccaatgcaagtctctaagttgtttttataaatgatctgtagttccgtggcttgcatgggtgcaccaatcatctttagaacgatgtacactgatgttcatctcataaatgtcactctttagagaatgttacttagttaaacatgcagtgaagatcgaatttttttcccaagaacagatgtgttagggagaggggcttcagctaaatagtccaaaccctagggtgcttaaagccaagttagtgcaggctgagccccttggttcacagtcaagcctccttgtttcctagggtgactgtagagaaatgtatttccggatgaggtttctgatctaggccatttgaccaaactttgctgtgtctaagatattagcatgtttttgaaatatttattttttaagatgtttaggagtaaggtcgtgttgtcttcctcaactaaaaagaagtttactgttgtatcgtctccctgaggtgaacgttgttgggttgctagcaagggcagtagcttaaatacttttgttgcctactctgaaagctcatcaaatgagagcccttttatttccaagcagaatttagtcagataattttgcttctaggatatagtatgttgtatatgatgctgtgattgccctggagttcctgccatgacatggaaacctggtggtatggaagcatgtactcaaaatatagacgtgcacgatggtggtgtggcttacccaggatggaaacactgcagttcttacttgcattcccactgcctttcatggggggtgactgggtagaggccaggagaaaggaaagagttgtaaaataaaaaactgctagttcataaaatgtcataaaaaattgtaaacttgaaaagcttaatgctattcaaaagaccttcaagcttccaaacttgtattgaagggagacgactgtttcctcctccaaaatgctcctgctcctcttgttcggttaaccagcacataacattgtgatggggaacctgggttcctctataagataattcttctccatcatctttaaggtaatctgatggttttccaggtggctttcattattgttccatctttgaaaaggcaatagaacccaggggtctgagcatggagctatccagggttttcatccaaaggttgggcctcttcttaagaggtccttttgtgtttcagttgattgaagatgatacttacctcattggaggtgtggcaaggatcttatcagaaggctttgtgttcttgtagttgtcatggctactacagtgtgggtgatttattgaatgaattcactagccacttgtgtcctggagcccccagttcaaatctttccattggactggaggcttgtgggaggctgggaggtggctgtctcctagtgtctacatccgtgtctctgaagcatcaggaaaagtgagatgacttagaggcaactgggcactgaatcagaggagcagagttatttttcagaatttgcacatggaacacttagatttggctggtgcttccagccctggaaggcataacatttacggactcatccccagctgcactgaaggcaggtggtggtacagacttatgaggacggatcagtttgccaaggctgatggtattgggtcactgagcctggtatccatggccgctgaccaggaagcttatgcaaagtggaagcaaggaacaaggcagaataactcagtcactttcatgaagatttttctaaacaagaaggcttaccaccaaaaaagaggtaccctagtggttaccctttgcagatgtgaaagctggaaaacttgacttttctttttggtaatgacttgcatttatctggtgcctttcgttggaggaatcccaacgtgctttagagactatctttttaacatctcttgtacatacatatatacttatataaaatattatcttgcccaactggacctttactcacttctgagcatgagaatgtcccaatagcattgagtttttcaagtggtggtttcagataagtgggagaaagaacaacccggctggcttaaaccctggagctaattcccacaaggaatgtagactgaatggtgacccagggagaaataatcttcctctcccctaaagtctcactaaggtttgaagtttacaggtgctctccactgggtctttgatcgaccttgctagataacatctaaccagcagtttct

SEQ ID NO: 23258 - DNA, 2333 bp, Homo sapiens
cgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggagtactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttctatgccacgttggctgtagacaccaaggaggaagagagtgaggatattgagaacatgggcaaggtggtccagatcctacggcttatgaggattttccgaattctaaagcttgcccggcactcggtaggacttcggtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaagtactaccagaagcaaaaggacattgatgtggaccagtgcagtgaggatgcaccagagaagtgtcatgagctaccttactttaacattagggatatatatgcacagcggatgcacaccttcattaccagtctctcttctgtaggcattgtggtgagcgatcctgactccacagatgcttcaagcattgaagacaatgaggacatttgtaacaccacctccttggagaattgcacagcaaaatgagcgggggtgtttgtgcctgtttctcttatcctttcccgacattaggttaacacagctttataaacctcagtgggttcgttaaaatcatttaattctcagggtgtacctttcagccatagttggacattcattgctgaattctgaaatgatagaattgtctttatttttctctgtgaggtcaattaaatgccttgttctgaaatttattttttacaagagagagttgtgatatagtttggaatataagataaatggtattgggtggggtttgtggctacagcttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagtatggagaa

SEQ ID NO: 23259 - DNA, 2397 bp, Homo sapiens
agtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggagtactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttctatgccacgttggctgtagacaccaaggaggaagagagtgaggatattgagaacatgggcaaggtggtccagatcctacggcttatgaggattttccgaattctaaagcttgcccggcactcggtaggacttcggtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaagtactaccagaagcaaaaggacattgatgtggaccagtgcagtgaggatgcaccagagaagtgtcatgagctaccttactttaacattagggatatatatgcacagcggatgcacaccttcattaccagtctctcttctgtaggcattgtggtgagcgatcctgactccacagatgcttcaagcattgaagacaatgaggacatttgtaacaccacctccttggagaattgcacagcaaaatgagcgggggtgtttgtgcctgtttctcttatcctttcccgacattaggttaacacagctttataaacctcagtgggttcgttaaaatcatttaattctcagggtgtacctttcagccatagttggacattcattgctgaattctgaaatgatagaattgtctttatttttctctgtgaggtcaattaaatgccttgttctgaaatttattttttacaagagagagttgtgatatagtttggaatataagataaatggtattgggtggggtttgtggctacagcttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagta

SEQ ID NO: 23260 - DNA, 553 bp, Homo sapiens
agggaagagcgaacccagggcccttgctctcgtgcagcgctgcgccctgggtggggacggcgtgaggcttgcagcgcaggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggagtactactttgatcggaatccctcct

SEQ ID NO: 23261 - DNA, 3320 bp, Homo sapiens
caaccaccaaacagacaagcccttcggcctgtcctggagggcgttgaatggcatggcctggagctcaaccaggagaaccgtgctcaggaggaagagaccagaaggataactcaaaaagttctgagaagttcctaagaccacctgaagagaaggagcctgctgccaatggtgtggacaccgcagtgtgcttgaggagacttcagaaacgagaactggaaaaatccctctgctttctctggccagtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtgaggggtggattaatgacactgtttcactgtttctctaaaatcacgttcttttgtgatagactgtcagtggttcccccatatctgtccctgccttgctaaatttagcagaatccctgaggacatggcctctgagaatagcagctgcatttcccagactcccttgcagctagcaaggttgtgtgactaagccctggccagtaggcatggaagtgaagactgtaatgtccaagtaatccttggaaagaaaagaacgtgcccttaactaactttgtcctgcttcccagtggctggatgtggaggaggtggagagcagttatgagactgggaaagaacggggcactcaaagagccacacacatctgggcctgggcgacgtggatcctccttaccacccaccaggccagatttacaggagagagaaatccactccactcttccttaagccactgttattctgatctctgttaaggtcgcagaatcaatgcccttactgatacacctaccttataggactgaacctaaaggcatgacatttccatacttgtcacaagcacacactgattctgcccttgtcacttctgtgctcactcttgtggctctatcctcctcctgcccttccgccttccactcctcccttgcacccatcctgcacacatctccctgaaaacacacaggcacatacactcatatacatagacacacatacacacctcaatctagaaagaacttgctttgtacagggctgagatggaggagaaaaaaatgcccccttcagaatgcataccaaggggaaggtgctcggtcactgtgggagcagggaaaggtgcccccactccccgagagccaggggaaggagtggctctgggcagagagggacacatagcactggggtggcaggtccttttgaggtgatgggccggttttgtgagatgaattgtatcccccaaaaagacaggtaccttcaatgtgacctaattgggaaatagagtctttgcagatgatctagttgagatgaggtcattggggtgggccctcacccaatatgactggagtccttatcggaagagggaaattcagacacagatgcatagggaggacaccatgccgtgacagaggcagagggtgcagtgacacagccacaaaccaaggaaggccgaggatggatgcgcatccccatcccaagaagtcgggaagaagccaggaaggctcctctcccacaggtttcagaggaagcacagccctgcttgaattcaaacttttggcctccagaactgtgagtcagtacctgttgttgaagccacccagcttaggatactctggcagcctactgccatacagtattgggatactatagtgagcccatgcagcacctctcacccacccagagatggagctgctctgccttccagcggggcacccggagggctgccccagcagatagagagggcctccgttctgccacctgccttgaaagggtctccagctgccatatgtagcattggagtcctctgcaatgcgacatcctgaaagctcagctgcctgggcattcctgaagagtatggaatatttaaatgaaacatatttttttaaaacctgcgcataagataaaagcagcccgtgtgcatcttgggccatcctcaaatggacagacttggtcttgtgaggttccagtccttgtttcacataataaacactggcatggctcagcccctgagttaccacagtccttgagatgagtggttctttgggttacaaagtcctctgaaagtctagtgagagctgtgatctttgccccacccgaataatgcatatggacaccacaccttgcctgccgtgtccaggattcatgaccagtagcagcccagctatgcctgccacgtctcatggcccctgtgtaagccagacccttcttaggcagttgcatattcccagactgaggcagggcaggtttgcagagagagacccagagtgcacgtgacccgcagtgtgatccctggcacgcactgactttgatattccaggcacacggactggctatttatcaccacttctttttccccactaagattcctgtgccttttaaggcagagggagatccctatggcgttagtcttcccaggccttaaagggcccttgtcttcactcacaaacctcttatctcttcttctccttcctctacattttaaagggggagagggaaaagtaaccgggagacaaattgagccacatattttcagacacttgttaccatattttaaaatctggcttcacatacacagagtctttgctatgcaccatgtactgttctaagcttcttaaaaatagaatctcaattattattttgcaggcaatactctatgcattcattagctaggacaacaatgcatttgcagtagtgagatttcgctaaaaaattaaagccatttactatg

SEQ ID NO: 23262 - DNA, 666 bp, Homo sapiens
gagaaccgtgctcaggaggaagagaccagaaggataactcaaaaagttctgagaagttcctaagaccacctgaagagaaggagcctgctgccaatggtgtggacaccgcagtgtgcttgaggagacttcagaaacgagaactgtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatga

SEQ ID NO: 23263 - DNA, 1204 bp, Homo sapiens
gaaatcacaaattacaaaacgtcagagtactttctggaaataagccttcctctccagggaacaacgcatttgacacttgactgggatacactaccggatcctccgagggtgatggttctcaagaaggcagaagcaatggtgaccaatagacctccttaaaggctgagccgctgggcaccttcctactcctctcgaccgtgctaggatgactgcagcagagtccccgagtcctttgatgcaagggtctagcaaccaccaaacagacaagcccttcggcctgtcctggagggcgttgaatggcatggcctggagctcaaccaggagaaccgtgctcaggaggaagagaccagaaggataactcaaaaagttctgagaagttcctaagaccacctgaagagaaggagcctgctgccaatggtgtggacaccgcagtgtgcttgaggagacttcagaaacgagaactggaaaaatccctctgctttctctggccagtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtgaggggtggattaatgacactgtttcactgtttctctaaaatcacgttcttttgtgatagactgtca

SEQ ID NO: 23264 - DNA, 3154 bp, Homo sapiens
gggctgtctgtggcctcagcgctcggcaggcgcgcactcagctccacacccggctctctcggcatctcagacccggtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtgaggggtggattaatgacactgtttcactgtttctctaaaatcacgttcttttgtgatagactgtcagtggttcccccatatctgtccctgccttgctaaatttagcagaatccctgaggacatggcctctgagaatagcagctgcatttcccagactcccttgcagctagcaaggttgtgtgactaagccctggccagtaggcatggaagtgaagactgtaatgtccaagtaatccttggaaagaaaagaacgtgcccttaactaactttgtcctgcttcccagtggctggatgtggaggaggtggagagcagttatgagactgggaaagaacggggcactcaaagagccacacacatctgggcctgggcgacgtggatcctccttaccacccaccaggccagatttacaggagagagaaatccactccactcttccttaagccactgttattctgatctctgttaaggtcgcagaatcaatgcccttactgatacacctaccttataggactgaacctaaaggcatgacatttccatacttgtcacaagcacacactgattctgcccttgtcacttctgtgctcactcttgtggctctatcctcctcctgcccttccgccttccactcctcccttgcacccatcctgcacacatctccctgaaaacacacaggcacatacactcatatacatagacacacatacacacctcaatctagaaagaacttgctttgtacagggctgagatggaggagaaaaaaatgcccccttcagaatgcataccaaggggaaggtgctcggtcactgtgggagcagggaaaggtgcccccactccccgagagccaggggaaggagtggctctgggcagagagggacacatagcactggggtggcaggtccttttgaggtgatgggccggttttgtgagatgaattgtatcccccaaaaagacaggtaccttcaatgtgacctaattgggaaatagagtctttgcagatgatctagttgagatgaggtcattggggtgggccctcacccaatatgactggagtccttatcggaagagggaaattcagacacagatgcatagggaggacaccatgccgtgacagaggcagagggtgcagtgacacagccacaaaccaaggaaggccgaggatggatgcgcatccccatcccaagaagtcgggaagaagccaggaaggctcctctcccacaggtttcagaggaagcacagccctgcttgaattcaaacttttggcctccagaactgtgagtcagtacctgttgttgaagccacccagcttaggatactctggcagcctactgccatacagtattgggatactatagtgagcccatgcagcacctctcacccacccagagatggagctgctctgccttccagcggggcacccggagggctgccccagcagatagagagggcctccgttctgccacctgccttgaaagggtctccagctgccatatgtagcattggagtcctctgcaatgcgacatcctgaaagctcagctgcctgggcattcctgaagagtatggaatatttaaatgaaacatatttttttaaaacctgcgcataagataaaagcagcccgtgtgcatcttgggccatcctcaaatggacagacttggtcttgtgaggttccagtccttgtttcacataataaacactggcatggctcagcccctgagttaccacagtccttgagatgagtggttctttgggttacaaagtcctctgaaagtctagtgagagctgtgatctttgccccacccgaataatgcatatggacaccacaccttgcctgccgtgtccaggattcatgaccagtagcagcccagctatgcctgccacgtctcatggcccctgtgtaagccagacccttcttaggcagttgcatattcccagactgaggcagggcaggtttgcagagagagacccagagtgcacgtgacccgcagtgtgatccctggcacgcactgactttgatattccaggcacacggactggctatttatcaccacttctttttccccactaagattcctgtgccttttaaggcagagggagatccctatggcgttagtcttcccaggccttaaagggcccttgtcttcactcacaaacctcttatctcttcttctccttcctctacattttaaagggggagagggaaaagtaaccgggagacaaattgagccacatattttcagacacttgttaccatattttaaaatctggcttcacatacacagagtctttgctatgcaccatgtactgttctaagcttcttaaaaatagaatctcaattattattttgcaggcaatactctatgcattcattagctaggacaacaatgcatttgcagtagtgagatttcgctaaaaaattaaagccatttactatga

SEQ ID NO: 23265 - DNA, 796 bp, Homo sapiens
atttgcaggtgtctcgctcagcgcagctgcccagagccctgtgtcctgagtgatttccagtagattagcagctctgggtctaagcttttaagaaaaaaaaaaaattgcactacccttcagtaggggcagcattcacatctcacacccaggcagaagcagaaacggccaggaatccaccccactttctgggcctgacaaggccacagtttgagaacgttcagcacaggccaagcatcagatggattttgaacatctctggctcctaccatttctgcctccaccatccctttactcactgtgcaagctacaaaagctgaggggacaggaacaaggatgatttctgatggcatatttagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatga

SEQ ID NO: 23266 - DNA, 3181 bp, Homo sapiens
gggctgtctgtggcctcagcgctcggcaggcgcgcactcagctccacacccggctctctcggcatctcagacccgggaaaaatccctctgctttctctggccagtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtgaggggtggattaatgacactgtttcactgtttctctaaaatcacgttcttttgtgatagactgtcagtggttcccccatatctgtccctgccttgctaaatttagcagaatccctgaggacatggcctctgagaatagcagctgcatttcccagactcccttgcagctagcaaggttgtgtgactaagccctggccagtaggcatggaagtgaagactgtaatgtccaagtaatccttggaaagaaaagaacgtgcccttaactaactttgtcctgcttcccagtggctggatgtggaggaggtggagagcagttatgagactgggaaagaacggggcactcaaagagccacacacatctgggcctgggcgacgtggatcctccttaccacccaccaggccagatttacaggagagagaaatccactccactcttccttaagccactgttattctgatctctgttaaggtcgcagaatcaatgcccttactgatacacctaccttataggactgaacctaaaggcatgacatttccatacttgtcacaagcacacactgattctgcccttgtcacttctgtgctcactcttgtggctctatcctcctcctgcccttccgccttccactcctcccttgcacccatcctgcacacatctccctgaaaacacacaggcacatacactcatatacatagacacacatacacacctcaatctagaaagaacttgctttgtacagggctgagatggaggagaaaaaaatgcccccttcagaatgcataccaaggggaaggtgctcggtcactgtgggagcagggaaaggtgcccccactccccgagagccaggggaaggagtggctctgggcagagagggacacatagcactggggtggcaggtccttttgaggtgatgggccggttttgtgagatgaattgtatcccccaaaaagacaggtaccttcaatgtgacctaattgggaaatagagtctttgcagatgatctagttgagatgaggtcattggggtgggccctcacccaatatgactggagtccttatcggaagagggaaattcagacacagatgcatagggaggacaccatgccgtgacagaggcagagggtgcagtgacacagccacaaaccaaggaaggccgaggatggatgcgcatccccatcccaagaagtcgggaagaagccaggaaggctcctctcccacaggtttcagaggaagcacagccctgcttgaattcaaacttttggcctccagaactgtgagtcagtacctgttgttgaagccacccagcttaggatactctggcagcctactgccatacagtattgggatactatagtgagcccatgcagcacctctcacccacccagagatggagctgctctgccttccagcggggcacccggagggctgccccagcagatagagagggcctccgttctgccacctgccttgaaagggtctccagctgccatatgtagcattggagtcctctgcaatgcgacatcctgaaagctcagctgcctgggcattcctgaagagtatggaatatttaaatgaaacatatttttttaaaacctgcgcataagataaaagcagcccgtgtgcatcttgggccatcctcaaatggacagacttggtcttgtgaggttccagtccttgtttcacataataaacactggcatggctcagcccctgagttaccacagtccttgagatgagtggttctttgggttacaaagtcctctgaaagtctagtgagagctgtgatctttgccccacccgaataatgcatatggacaccacaccttgcctgccgtgtccaggattcatgaccagtagcagcccagctatgcctgccacgtctcatggcccctgtgtaagccagacccttcttaggcagttgcatattcccagactgaggcagggcaggtttgcagagagagacccagagtgcacgtgacccgcagtgtgatccctggcacgcactgactttgatattccaggcacacggactggctatttatcaccacttctttttccccactaagattcctgtgccttttaaggcagagggagatccctatggcgttagtcttcccaggccttaaagggcccttgtcttcactcacaaacctcttatctcttcttctccttcctctacattttaaagggggagagggaaaagtaaccgggagacaaattgagccacatattttcagacacttgttaccatattttaaaatctggcttcacatacacagagtctttgctatgcaccatgtactgttctaagcttcttaaaaatagaatctcaattattattttgcaggcaatactctatgcattcattagctaggacaacaatgcatttgcagtagtgagatttcgctaaaaaattaaagccatttactatg

SEQ ID NO: 23267 - DNA, 803 bp, Homo sapiens
gtaaggtgaaggtgcccagcaggctgaggcttgtgtgcaacccagaagagagctcgctaacgccagcaagaaggttcagaacagcctggctttggaaaggaatttcatcctgcccacacactgcatagcaggagggaagcatgtctactttatccaatttcacacagacgctggaagacgtcttccgaaggatttttattacttatatggacaattggcgccagaacacaacagctgagcaagaggccctccaagccaaagttgatgctgagaacttctactatgtcatcctgtacctcatggtgatgattggaatgttctctttcatcatcgtggccatcctggtgagcactgtgaaatccaagagacgggaacactccaatgacccctaccaccagtacattgtagaggactggcaggaaaagtacaagagccaaatcttgaatctagaagaatcgaaggccaccatccatgagaacattggtgcggctgggttcaaaatgtccccctgataagggagaaaggcaccaagctaacatctgacgtccagacatgaagagatgccagtgccacgaggcaaatccaaattgtctttgcttagaagaaagtgagttccttgctctctgttgagaattttcatggagattatgtggttggccaataaagatagatgacatttcaatctcagtgatttatgcttgcttgttggagcaatattttgtgctgaagacctcttttactttccgggcaagtgaatgtcattttaatcaatatcaatgatgaaaataaagccaaatttgaag

SEQ ID NO: 23268 - DNA, 3143 bp, Homo sapiens
ggtgtgctggggcccgggcggggcagggggaggggacgcccgggggagggaaaagggagccgagcgcgggtgggagcccagagccagagagcgcgctgggcggtgctgggcacccgcggagtggaacggggctggtggaatgcacagggtcgcagcgcttgggccaccctcggtcagagggcgccgtgtccagcgagcaaacgggcgccccggagccttgctgagaggcagctctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccgtgatgacaactcctacatgtacattctctttgtcatgtttctatttgctgtaactgtgggcagcctcatcctgggatacacccgctcccgcaaagtggacaagcgtagtgacccctatcatgtgtatatcaagaaccgtgtgtctatgatctaacacgagagggctgggacggtggaagaccaagacacctggggattgcgtctggggcctccagaactctgctgtggactgcatcaggtctcagtgtccctatctgtaagatcaacaagaaacacggttaagggaggtcgtcactggggtgggagaagaggggctggtagaccgaagccttgtgcataaggattttttcccaggaaaagatagactttataaacagtgggagcccatgaacaaacatataaaagtagcaacagataatgaccaataactggttcagtggctggagtattaggggcctggggattggagaacggagaagaagttgtagcagagggaaatgagacaggaagatgctctggggacacattttttatgtgttatcttcagccatgagaagcagtgatgactatcccatatcacagatatgatttaccaccaccaccctgcccccgctcccgtgaagaaagcagggcaagtgctgtgctgcccatttgggcctgcatagtgccatgattggaacccaggaactctggtctccttgcctagtgcttttcaaaactctgtgctacacaggagtggatccaggcctgaaggtcatacaattctggggactctctttaagaaaaagaattctaaaatatcttacttttgcaaacattatgaaaatatactgccacattaatatgttgctagggcccctgctaggaccttaagaaggagctcatgtgagtcaggaccctgaatgttaggcctcgttagctctatggttcatatgcttcttgaaccaagtcacagggcacttcccagccacattgccaggcaacaggactaaactacctccaaagcaagcagtcttttcagttttgactgagtgatgtgagaaacttcttttcttttcttttctttttttttttttgagacagtctccctatgtcacccaggctgtggtgcagcaacccaatcttggctcactgcaacccccacctcccgggttcaagcaattatcctgcctcagccacctgagtagctgggattacaggttcctgtcaccacacccagttaatttatatatatatatatatatatatatttaagtagagacagggtttcacatgttgcccaggctggtctcgaactcctgtcctcaagttatctgcccattttggtctcccaaagtgctgggattacaagtgtaagccaccacgactatctgagagaagttttctgatgtcatgttgaatctgcttctaaaagactgatactgccaaggtgggcggatcacctgaggtcaggagttcgagaccagcctggccaacatggtgaaaccccatctactaaaaaaatacaaaaattagccagacctggtggcgggtgcccgtattcccagctacttgggaggctgaggcaggagaattgtttgaacccgggaggtggaggttgcagtaagccaagatcacgccactgcactccagcctgggtgacagagcaaggctctgtctcaaaaaaaaacaaaaacaaaaacaaaaaagactgatatcgcacctaaattattattatattaaaagaagcagagtatgagagacaggtacatggtccagtaggaagagaagcagccctgattctaccacttaaggtgatgtatgatcttaggctggacacttctctccctcatccgttttcctcttcaacataatgaaatagacttgaaagtctctaaggctctatcagttctgacattctaggcttcatatacattaagttgagccatatgtaatcactgtgtttgtaggttagaaacagctgagtatcgtagtttcatatatggttccagctaatacatgcaatgtggctggtgaacacttctgaattcagaaactatcccagatctcagctagaaccatccactgttctgtttgtccagtttcaacttaagggatctccatgcggtccctggaagtacccattgaaacatgcgtatttgtgtatagcagaactctgaaataatattctgacagcagttatctctgaggaattgggttataggtgattttccctttccgcatgataaatttatgtaatatttgactgacttgaccgtaagtatgttacttgtataataaaaggaaaaaaggtacttctattttgaaaaaataaaaataaaagcctttgggttcttgaatggaggatcatggaacacatttgctgccatatgcagttatgttgatgctctgcaaacctgtgctgagccctgttgctcaagcccttcctcatctcttcttgagggagaaggtggagacttccttaaggagatgtgacatatgggaagacaacagattcagaaatttacgtggataggactttagacaccacccagcccaaacttccaaataaaatatggaacgcaa

SEQ ID NO: 23269 - DNA, 935 bp, Homo sapiens
tcacccagtgaagacactgtaagtctggaggtaggggacagcaatcagaggccctttggtcactgcacagttcctttaactgcaaccctaggctggcctgacccagctgctgcaggaaggggaggggccatgggagggggtcagagcccacagcaggactgttgcataatccttggggcctggccttgggcaatccaccctggttctgaagtttgtgctttgtgtctggttccttccttttctgccttctctcctgctttctagctctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccgtgatgacaactcctacatgtacattctctttgtcatgtttctatttgctgtaactgtgggcagcctcatcctgggatacacccgctcccgcaaagtggacaagcgtagtgacccctatcatgtgtatatcaagaaccgtgtgtctatgatctaacacgagagggctgggacggtggaagaccaagacacctggggattgcgtctggggcctccagaactctgctgtggactgcatcaggtctcagtgtccctatctgtaagatcaacaagaaacacggttaagggaggtcgtcactggggtgggagaagaggggctggtagacc

SEQ ID NO: 23270 - DNA, 550 bp, Homo sapiens
agagccagagagcgcgctgggcggtgctgggcacccgcggagtggaacggggctggtggaatgcacagggtcgcagcgcttgggccaccctcggtcagagggcgccgtgtccagcgagcaaacgggcgccccggagccttgctgagaggcagacactgaagacgctcattctgaaagagtagctgaaacggagtgacgggaaagaaagacccaaggatgcggacagaagctgaggcccagaaaagggaagtcttatgtccaaagtcacacaaggagcagctgagctgggacaactcccctggtttccatttccttcaccgtaaactctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgaga

SEQ ID NO: 23271 - DNA, 555 bp, Homo sapiens
cagagccagagagcgcgctgggcggtgctgggcacccgcggagtggaacggggctggtggaatgcacagggtcgcagcgcttgggccaccctcggtcagagggcgccgtgtccagcgagcaaacgggcgccccggagccttgctgagaggcagacactgaagacgctcattctgaaagagtagctgaaacggagtgacgggaaagaaagacccaaggctctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcct

SEQ ID NO: 23272 - DNA, 607 bp, Homo sapiens
agagccagagagcgcgctgggcggtgctgggcacccgcggagtggaacggggctggtggaatgcacagggtcgcagcgcttgggccaccctcggtcagagggcgccgtgtccagcgagcaaacgggcgccccggagccttgctgagaggcagatgcggacagaagctgaggcccagaaaagggaagtcttatgtccaaagtcacacaaggagcagctgagctgggacaactcccctggtttccatttccttcaccgtaaactctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccg

SEQ ID NO: 23273 - DNA, 585 bp, Homo sapiens
ccaggaagcaggcgctgcaggggacggaagggtcggagcccacagccgggggaggccaaggagctgggcggaggcactccaggccagcccggggagaactctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccgtgatgacaactcctacatgtacattctctttgtcatgtttctatttgctgtaactgtgggcagcctcatcctgggatacacccgctcccgcaaagtggacaagcgtagtgacccctatcatgtgtatatcaagaaccgtg

SEQ ID NO: 23274 - DNA, 3291 bp, Homo sapiens
attatgggattcagctgcctctgaaaacctgtagcccaataatggttattccccaggagccgcgcgaagcatgagctaattttcagtgagcgcggactttggggtaacggttccagcacagcacatccctttctcctcttttcactcatcgtcaccgctacctgaaaaccctggccgggtgctggggcttgaggagcagttcccacttcccagtctttttcacttttcacagctgcaaagttcagggagttgaactgcagtgctttcagttcactgctcactctgccacgatcaatctctgttgtaaattttcctcccagagcacgtgacgatgcacttcttgactatatatcccaactgcagcagcggagttgtcagagcgcagagccggacagagcagaagaaccctcttggactggacgatttgggaattcaaaacttgggacaaactgtcagccttgcccctgctgtggaggcagcctcaatgctgaaaatggagcctctgaacagcacgcaccccggcaccgccgcctccagcagccccctggagtcccgtgcggccggcggcggcagcggcaatggcaacgagtacttctacattctggttgtcatgtccttctacggcattttcttgatcggaatcatgctgggctacatgaaatccaagaggcgggagaagaagtccagcctcctgctgctgtacaaagacgaggagcggctctggggggaggccatgaagccgctgcctgtggtgtcgggcctgaggtcggtgcaggtgcccctgatgctgaacatgctgcaggagagcgtggcgcccgcgctgtcctgcaccctctgttccatggaaggggacagcgtgagctccgagtcctcctccccggacgtgcacctcaccattcaggaggagggggcagacgatgagctggaggagacctcggagacgcccctcaacgagagcagcgaagggtcctcggagaacatccatcagaattcctagcacccccgggacccctgccggtggctccatcagccagcaaccttagagagaggaaagacagttttcaagtgtctggtttcactttcacagtgcggctgccactttgaagagacccttggtaaacccctgattcggggtggggtgggggactaggctcagccggaaccagcacctccaaggagtccgggaggtgcctgtggtttgcacccaccactgaaaaagccgcggagatgcgcagcgcgtacactgactttggggcctgggtgttggggttctgatcagaatttggcgggatgatatgtttgccattttctcactggatgccctgggtagctcctgcagggtctgcctgttcccagggctgccgaatgcttaggacacgctgagagactagttgtgatttgctattttgcctagagctttgtccttctagatctgattggctgtaagtatctctactgtgtacctgtggcattccttcacagtgggttacaagcttcttttggattagagggggatttttgatgggagaaagctggagatctgaacccagcccatttgcacactataagaaaaaaaagtaacttttaaacctgttaacattggccggggttataagagatgatcttctattttgaccttttgtctaacttatgaccttgaactctgacctgtgaccatgcagcatcacatgatggcatgacgttctttggatcagaagagcttccccagaatctaacctgcactcccgatggtggttcaggagactcttcctgatctttctagaaggggtaaagtggggttgaacaaggccaagccgttagctctgctgctgctcagtttcccagcctagttttctgagctgggagaggacataatgtggtatttcgtcacgtagctgagacctagaagggcatactcaggcggagattgcacaaagctgggctccaagttctgtgcttcctgatcccgagccctgacactcatttgctgtgtggtcccgggcatgtcatcaagaagctcgctgtctgcatgaggctcccgacgatctccatccccagggggttgggaggatgtctttagattttaggactctgtgataaatattccacagcctggtgtgaggaagcttggaccaaatgcttcccctttggccggttagtctgaacaaggatctgctgatttaaaggagcagttggagattcagaacacatataactggggaattcagggcaagctaccaacccagccctgctgtagttttcccaggactgaaggaaagaggcagacaccacattctcctctgcaaagttctctggagaatgtgtgatgttaacactcccagctaagggaaagcaaagtctaaaggaaaacacacaggaatgcttccaatgtctccaagtattcctgtggtcaacagtttcgcagatccgttaggcccttaaagacaaggaggaagtaaaaggtcaaatttaaatctatttaaaaaaacttttaaaaaaattatttatttattattattttttatttttaagacagaatctcgctctgttgcccaggctggagtgcagtggtgcaatcttggctcactgcaacctccacctcctgggtttcagcgattctcctgcctcagcctcctgagtagctgggattacaggcgcctgccaccacgcccagctaattttttgatttttagtagagatggggtttcgccattttggccaggctggtctcaaactcctggccttaaatgatcctcccacctcggcctcccaaagtgctgggattacaggcatgagccactgcacccggccactttttttttttttaaagaaaaatgctctgcatggattggagacacagcaataactactgttgccatggaagggttaacagtgtaggagctggtttatcagtccgctttgacatacagctaaaggaaatttatgtttgggggaaaaaggccctctgttcactttaaaattcagtgtggacttatgccaaagggggctgtttaagttgaaagaagccaagttaagtttggcctcttgcctggaatcacttgaattctgaaatttcactgcgacggacatgtgccttgtcacattttccattgcttaatcctgaagtttggtgcaagtctctctgcacctattaaaaagtgatgtatatacttccttcttattctgttgagttgtatagaattgtcttttgtatttaacactttgtaattttcacaatattttttaatttaaataaataaacacattttttccctcctgggaagtcatgaa

SEQ ID NO: 23275 - DNA, 3127 bp, Homo sapiens
gcggcggggctggcagcagtggctgcccgcactgcgcccgggcgctcgccttcgctgcagctcccggtgccgccgctcgggccggccccccggcaggccctcctcgttatggccgcggcctcctccccgcccagggccgagaggaagcgctggggttggggccgcctgccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtcttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcaca

SEQ ID NO: 23276 - DNA, 2159 bp, Homo sapiens
ctcttcccttcctcccctgcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggacttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccc

SEQ ID NO: 23277 - DNA, 1423 bp, Homo sapiens
cggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacaggtaccgccgccgggcacctgccaccaagcaactgtttcattttttattttccatttgttcttaaaccccactttttgttgttcattattttgattgattttttttctttaaaatgtatttttcacaaagg

SEQ ID NO: 23278 - DNA, 2979 bp, Homo sapiens
cggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccaggatagatatgattgtgggtcccccgcccccttcaactccccggcacaagaagtaccccaccaaaggacccacggcccctccgagagagtcaccccagtactcacctagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacagg

SEQ ID NO: 23279 - DNA, 3275 bp, Homo sapiens
cgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcaaacggggatagatatgattgtgggtcccccgcccccttcaactccccggcacaagaagtaccccaccaaaggacccacggcccctccgagagagtcaccccagtactcacctagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtc

SEQ ID NO: 23280 - DNA, 3195 bp, Homo sapiens
cggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtc

SEQ ID NO: 23281 - DNA, 3249 bp, Homo sapiens
cggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagtaaaggcagcccgtgcagagggcccctgtgtggatgctgccccggacgctctagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtc

SEQ ID NO: 23282 - DNA, 3251 bp, Homo sapiens
cgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagtaaaggcagcccgtgcagagggcccctgtgtggatgctgccccggacgctctagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcaaagccaagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtc

SEQ ID NO: 23283 - DNA, 2908 bp, Homo sapiens
cggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggg

SEQ ID NO: 23284 - DNA, 1545 bp, Homo sapiens
cggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaaggtcagtgccccctgctgctaccctggtgtctgccgtgtgcacggccgtctggtctctctcccacacgtgtgcgcaacctgtcatggagatgtgagggccttgtgtgtgcttccgtgtgtgactgtgtgactgcgggtccagacccccgcctgg

SEQ ID NO: 23285 - DNA, 2325 bp, Homo sapiens
cggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccaggcaagagccccgcctgcctgtccagcaggggacaagaacggggtgggcttctgggacaaagcccactgtggcccatggtgggagtgcagggggtgtgtgggcggggcctcctccccacccacgtcggcctctgtcagcttctgttgtgtcttcacaaagtctgttttaatatttctgctgtctctcccatctctcccccatccacaccgcggtgggcaagtgcgtgcacctgtgtgtgtgggtccctgaaaatgtgtgtgtgcatgtgtgtgtgtgtaagtcacgcatgcacacatgtatgcttctgcacaggtgtatgtgtgtggttgtatgcacgtgtggctctgctctgccatgtatgcacgtgtgtggggtgcatacatgtgtgtacacatgtgtgcatgtgtgttggggatggaataattctgttcagacatgaagctgcagggttcccgtgggccccaccaggca

SEQ ID NO: 23286 - DNA, 3015 bp, Homo sapiens
cggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccaggatagatatgattgtgggtcccccgcccccttcaactccccggcacaagaagtaccccaccaaaggacccacggcccctccgagagagtcaccccagtactcacctagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacagg

SEQ ID NO: 23287 - DNA, 3159 bp, Homo sapiens
cggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtc

SEQ ID NO: 23288 - DNA, 3158 bp, Homo sapiens
cgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtc

SEQ ID NO: 23289 - DNA, 5356 bp, Homo sapiens
ggctggcaccgggcttgtaaataaactgcgatgctgtcttgggctcgccggcctgggtgccgccgccgccgccgccgccccggagcgccggttccaggctcccgccgccgcgcgccctagcgcctccgcgccagcctcgcgcgccctcccagcttctccgcagcccccggcccgcgaccctcggggtcctgcggctgacccgcgcgggatgtgaccccctgaccccctgcctggcctcccctgccccccagggggcccgcctttgcctgcttttgggggggggtggggaggggcgcgcggatcatggcattggagttcccgggcttgcagccgccgccgccgcctcgttcacgcaccccgagcgccccttcttcccagagcagcagcggagaaggcgaagcggccggcgggggcgaggcagatggggctcaaggcgcgcagggcggcgggggcggctggcggcggcggcgacgggggcggcggaggcggcggggcggctaacccagccggaggggacgcggcggcggccggcgacgaggagcggaaagtggggctggcgcccggcgacgtggagcaagtcaccttggcgctcggggccggagccgacaaagacgggaccctgctgctggagggcggcggccgcgacgaggggcagcggaggaccccgcagggcatcgggctcctggccaagaccccgctgagccgcccagtcaagagaaacaacgccaagtaccggcgcatccaaactttgatctacgacgccctggagagaccgcggggctgggcgctgctttaccacgcgttggtgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggatacacatttatctgctgttcttacttttaatcacgattggaccagtacagggagaaattactgatgagccatgctatttgtctgtttggttggctggtttgggttttggtttggtaagcagagaaagtagtttaagttatttctaggatcactgccctcttgtgtaaaacgctccagcaattaactgtttttgaaagcaaggaaataattttctcaacaaaaccacattgtgtatcagtggggctgcctactgagctaacattaggaaaggaatgagatagtcattgtgtctctaaaacaaagaatttaaacaaatatttaaggcaaaaccttttaaaagctctccaaaagacctcacttggcctgatgttacttagtatcatgcctcagtttccttatctgtaaaaagtggtggtaatcccaagtgtagcatttctgatgagttatgaattggcagggagaaaacacacacacacacacacacacacacacacacacacacatacacaaagttaaaatagtttccaatttatgtagccaaggacaatggaatttatcagaagtgaagtgcccctctgggcaggagctgagttcagtgcctttaaaatgaatttccaactctcatttcttcccatgatactgaagtacaaaatatccatctaaaatagaaattaaagtcaagaaggcacacagaaattttctagtccaaggacttccttttataaatgaagaatcttaggctcaggtaaagtgacatacccagagtcactcagttgtcccatagagaaccaggactcaaaagtcaggtctgcccactctccctgaccttgtttcccctcaccacaccattcttccatttatataatgcatcctagagattgtgtcaagatatatgactttgtgtcgcgtggaaagcacccagtttatccagcaggagggggatttccacttttattgcaaaacatgcttgcttgatgcaatgcatttcagatctagaaaaaaataatgcaagcaagctacatttacagatgtgtaaacaggcaaaatttccagaaccgtccaattttacttttccaaatttatggaaccaacccagattttttaaatgaaaatactaaaaccatatgtaaccgtaagacaagctaaaatgtaagcagacagcctgggaagcactgccctactgtacaggtgtgatattaagcacaagccatcctctggcctcttatgagatgttgttattctctgaaaaactttgatggaaaaggtttctgttaggcttagactgaattagctaaatgaccatgccacagtattattgtatcactcttctcacacacctaggcactggttgtggatagttgccatggtgacaatcaagataatccagatgacctaaacaaatgtctgtatgcagctgacactgctattctccctcacagtcttgtcaagagccacagtagctatggcagacatttggttgatggtttcatcatttcctaatacgagagtctggcactatgttggagagaggaatcacttcctcagagataggttcctttcaactcacatgtcaacagttactgtacaaaaagctcagaatacagtaatgattagagcttgacccctgactttaggaacttagaaccaaagcccaaagtcccaggccaagggcagacattgtgagcagcagaagggtgttttttatggagagccccataaatggatgggtgtagaccttgaagtctgagatgggaaatataccagaatgctcaatgcatcagacatgaagccccacgggcttccatttgacatgctggcaatctgaaggacaaagggcatgggttatttgggccttttccccactccttcaatatggctgaaagtgccagtggggattacaacctaagaaaccctatgccccttcctgagggcttgattattgaatcctgatcttcctggaatctttcacttgagatgatcacctgcctaacatccaacatgttactatgctcttctttatgtacatgagttactggaaaccaacaataaaggagagtgagtcata

SEQ ID NO: 23290 - DNA, 2256 bp, Homo sapiens
aagccaaaaaagcatggtcctatgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaa

SEQ ID NO: 23291 - DNA, 2550 bp, Homo sapiens
agagcagcagcggagaaggcgaagcggccggcgggggcgaggcagatggggctcaaggcgcgcagggcggcggccggcgacgaggagcggaaagtggggctggcgcccggcgacgtggagcaagtcaccttggcgctcggggccggagccgacaaagacgggaccctgctgctggagggcggcggccgcgacgaggggcagcggaggaccccgcagggcatcgggctcctggccaagaccccgctgagccgcccagtcaagagaaacaacgccaagtaccggcgcatccaaactttgatctacgacgccctggagagaccgcggggctgggcgctgctttaccacgcgttggtgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaa

SEQ ID NO: 23292 - DNA, 4099 bp, Homo sapiens
agccatgcgtctctgagcgccccgagcgcgcccccgccccggaccgtgcccgggccccggcgcccccagcccggcgccgcccatggccgaggcccccccgcgccgcctcggcctgggtcccccgcccggggacgccccccgcgcggagctagtggcgctcacggccgtgcagagcgaacagggcgaggcgggcgggggcggctccccgcgccgcctcggcctcctgggcagccccctgccgccgggcgcgcccctccctgggccgggctccggctcgggctccgcctgcggccagcgctcctcggccgcgcacaagcgctaccgccgcctgcagaactgggtctacaacgtgctggagcggccccgcggctgggccttcgtctaccacgtcttcatatttttgctggtcttcagctgcctggtgctgtctgtgctgtccactatccaggagcaccaggaacttgccaacgagtgtctcctcatcttggaattcgtgatgatcgtggttttcggcttggagtacatcgtccgggtctggtccgccggatgctgctgccgctaccgaggatggcagggtcgcttccgctttgccagaaagcccttctgtgtcatcgacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggagctgatcaccgcctggtacatcgggttcctggtgctcatcttcgcctccttcctggtctacctggctgagaaggacgccaactccgacttctcctcctacgccgactcgctctggtgggggacgattacattgacaaccatcggctatggtgacaagacaccgcacacatggctgggcagggtcctggctgctggcttcgccttactgggcatctctttctttgccctgcctgccggcatcctaggctccggctttgccctgaaggtccaggagcagcaccggcagaagcacttcgagaagcggaggatgccggcagccaacctcatccaggctgcctggcgcctgtactccaccgatatgagccgggcctacctgacagccacctggtactactatgacagtatcctcccatccttcagagagctggccctcttgtttgagcacgtgcaacgggcccgcaatgggggcctacggcccctggaggtgcggcgggcgccggtacccgacggagcaccctcccgttacccgcccgttgccacctgccaccggccgggcagcacctccttctgccctggggaaagcagccggatgggcatcaaagaccgcatccgcatgggcagctcccagcggcggacgggtccttccaagcagcatctggcacctccaacaatgcccacctccccaagcagcgagcaggtgggtgaggccaccagccccaccaaggtgcaaaagagctggagcttcaatgaccgcacccgcttccgggcatctctgagactcaaaccccgcacctctgctgaggatgccccctcagaggaagtagcagaggagaagagctaccagtgtgagctcacggtggacgacatcatgcctgctgtgaagacagtcatccgctccatcaggattctcaagttcctggtggccaaaaggaaattcaaggagacactgcgaccgtacgacgtgaaggacgtcattgagcagtactcagcaggccacctggacatgctgggccggatcaagagcctgcaaactcgggtggaccaaattgtgggtcgggggcccggggacaggaaggcccgggagaagggcgacaaggggccctccgacgcggaggtggtggatgaaatcagcatgatgggacgcgtggtcaaggtggagaagcaggtgcagtccatcgagcacaagctggacctgctgttgggcttctattcgcgctgcctgcgctctggcacctcggccagcctgggcgccgtgcaagtgccgctgttcgaccccgacatcacctccgactaccacagccctgtggaccacgaggacatctccgtctccgcacagacgctcagcatctcccgctcggtcagcaccaacatggactgagggacttctcagaggcagggcagcacacggccagccccgcggcctggcgctccgactgccctctgaggcctccggactcctctcgtacttgaactcactccctcacggggagagagaccacacgcagtattgagctgcctgagtgggcgtggtacctgctgtgggtgccagcgccccttccccacctcaggagcgtgagatgccaggtcgcacagagggcagcagcagcggccgtcccgcggcctctgggccccccagtgccctgcccactccatcaaggccctatgtggcccacctggcaggggcacagccccgggagtgggagcgggcgctggggccctgggccctgacccagcttccagctatgcaaggtgaggtctctggcccacccttcggacacagcagggaagccctcccgccaagtccccgccccacttgggggtgggccaaggtgcccccacaggtacccacaaagcacaggaccctgccacaaggcaggtggacaccatatatgcaaaccatgttaaatatgcaactttggggacccccatggggtctctctgtccctcccccattgggagctgggcccccagcagtagctggtctcaggctgcttggccaccaccctgtccctattctttggcttatcactccttcccctcccagcatggggcctgtttctcccctgccctctcctaagggcaatgcctgggcctttcttcccatttgcaagtgtcagctcccaggggctccctcctcctgctgggtggccactcccctccttggccctccagacaccactcatagtcagcacaggtttctgtatcctccccaaaactcccagacagtgcttcgtggacgatcgcacaaacatagccttttagtttctccagacaggaagaaagcctctcacacttaaacatgcaatgacgtgacacacttggagacatgagtgcagagccactcagccgctcctgggcctctgcagcagatgccagtggactggccttgcagggtgacgaccactaagaggaagacccccaactccatctgagcaggagaaggagctttgaagtaacccgagagctctccaggccccacccagacctttacccgctccccttcttcaagaagatctcctcctctctggtccaggagccctaacccactgcctctgcctgtccccaagggcccgcctccgtgtctccacagcacaactcgggcccaggcctgacaccactggagagaccccaggcccacttctagccaggcctgtgccttcctagtcactctaactcccagagagaataagaatgcatgtaatagctataccaaccgcgcatccggctttcacatgcactgtctcccctccctccacaccccacttcttcacttcaattggcagcgccacatccaggcgtcagcccccattcactccaggaacactttcttatccccacccctttgctcctcttctgcaaagccaatgcaggtggcaggaaggtgaggggtagtggaccaatggcaaccctctgtgggaacaaggggccgaggccacgctgcctgcatctcgtgctggggacctgcatgcgccagcaccagggcttggactggatcttactcagtccatggtgcccagcctctgccccaacatgccctctgcatgtgaccgtcatgccctggatggagccactcctggctcaccccacctgcactgcactgtccccagagagccacccctccacccactcagagacagctgtggagagggccaggagaatgggattaccctatgaccaaggagacatgggaagaagccctccttccttccacgatcgaggttccgccatcaactcggttctcggatatgcaagtacctcactttgttaacttattaacttattggtttcattaaagttttcaagagga

SEQ ID NO: 23293 - DNA, 6688 bp, Homo sapiens
ggctgggtgtgcgcgcgtgggagcgcgcctcggagcgccccgcactcccccactctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtaagttctgtagtaataagcagaagctcttcagaatgtacacctcacggaagcagagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacattaaaaagatgtctat

SEQ ID NO: 23294 - DNA, 6566 bp, Homo sapiens
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 23295 - DNA, 2802 bp, Homo sapiens
atgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagcagaaccagcaaggagaatcccagagttgtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataa

SEQ ID NO: 23296 - DNA, 1469 bp, Homo sapiens
ctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcaggtttgtgatttctctcttgctacatgtttgtttataaatctgatacctaccaggtgttttaaatgtgtctcatgtgagtaaaatcgatcaacaaatacaagatgattaaaagtgacctttcacaagattgcctgcaaa

SEQ ID NO: 23297 - DNA, 6345 bp, Homo sapiens
gggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacattaaaaagatgtctataaa

SEQ ID NO: 23298 - DNA, 2829 bp, Homo sapiens
atgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaataagttctgtagtaataagcagaagctcttcagaatgtacacctcacggaagcagagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataa

SEQ ID NO: 23299 - DNA, 2772 bp, Homo sapiens
atgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaatcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataa

SEQ ID NO: 23300 - DNA, 2469 bp, Homo sapiens
atgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataa

SEQ ID NO: 23301 - DNA, 6623 bp, Homo sapiens
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtaagttctgtagtaataagcagaagctcttcagaatgtacacctcacggaagcagagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 23302 - DNA, 7318 bp, Homo sapiens
gccgtcgggatggaggtgagaagacggccgtgacgcgcgcccgcggggccccctgcacccccagcagcccacagcgctccctgcccccctcccccgcagcagcgggccttgccgtcgagtgacagcggcctgggggggcagggggggcgggggcggccggatcagcgatgccggcgggcatgacgaagcatggctcccgctccaccagctcgctgccgcccgagcccatggagatcgtgcgcagcaaggcgtgctctcggcgggtccgcctcaacgtcggggggctggcgcacgaggtactctggcgtaccctggaccgcctgccccgcacgcggctgggcaagctccgcgactgcaacacgcacgactcgctgctcgaggtgtgcgatgactacagcctcgacgacaacgagtacttctttgaccgccacccgggcgccttcacctccatcctcaacttctaccgcactgggcgactgcacatgatggaggagatgtgcgcgctcagcttcagccaagagctcgactactggggcatcgacgagatctacctggagtcctgctgccaggcccgctaccaccagaagaaagagcagatgaacgaggagctcaagcgtgaggccgagaccctacgggagcgggaaggcgaggagttcgataacacgtgctgcgcagagaagaggaaaaaactctgggacctactggagaagcccaattcctctgtggctgccaagatccttgccataatttccatcatgttcatcgtcctctccaccattgccctgtccctcaacacgctgcctgagctacagagcctcgatgagttcggccagtccacagacaacccccagctggcccacgtggaggccgtgtgcatcgcatggttcaccatggagtacctgctgaggttcctctcctcgcccaagaagtggaagttcttcaagggcccactcaatgccattgacttgttggccattctgccatactatgtcaccattttcctcaccgaatccaacaagagcgtgctgcaattccagaatgtccgccgcgtggtccagatcttccgcatcatgcgaattctccgcatccttaagcttgcacgccactccactggcctccagtctctgggcttcactttgcggaggagctacaatgagttgggcttgctcatcctcttccttgccatgggcattatgatcttctccagccttgtcttctttgctgagaaggatgaggacgacaccaagttcaaaagcatcccagcctctttctggtgggccaccatcaccatgactactgttgggtatggagacatctaccccaagactctcctggggaaaattgttgggggactctgctgcattgcaggagtcctggtgattgctcttcccatccccatcatcgtcaataacttctctgagttctataaggagcagaagagacaggagaaagcaatcaaacggcgagaggctctggagagagccaagaggaatggcagcatcgtatccatgaacatgaaggatgcttttgcccggagcattgagatgatggacattgtggttgagaaaaatggggagaatatgggtaagaaagacaaagtacaagataaccacttgtctcctaacaaatggaaatggacaaagaggacactgtctgaaaccagctcaagtaagtcctttgaaaccaaggaacagggatcccctgaaaaagccagatcgtcttctagtcctcagcacctgaacgttcagcagttggaagacatgtacaataagatggccaagacccaatcccaacccatcctcaataccaaggagtcagcagcacagagcaaaccaaaggaagaacttgaaatggagagtatccccagccccgtagcccctctgcccactcgcacagaaggggtcattgacatgcgaagtatgtcaagcattgatagtttcattagctgtgccacagacttccctgaggccaccagattctcccacagccctttgacatcactccccagcaagactgggggcagcacagccccagaagtgggctggcggggagctctgggtgccagtggtggtaggtttgtggaggccaaccccagccctgatgccagccagcactctagtttcttcatcgagagccccaagagttccatgaaaactaacaaccctttgaagctccgagcacttaaagtcaacttcatggagggtgaccccagtccactcctccccgttctagggatgtaccatgaccctctcaggaaccgggggagtgctgcggctgctgtcgctggactggagtgtgccacgcttttggacaaggctgtgctgagcccagagtcctccatctacaccacagcaagtgctaagacacccccccggtctcctgagaaacacacagcaatagcgttcaactttgaggcgggtgtccaccagtacattgacgcagacacagatgatgagggacagctgctctacagtgtggactccagcccccccaaaagcctccctgggagcaccagtccgaagttcagcacggggacaagatcggagaaaaaccactttgaaagctcccctttacccacctcccctaagttcttaaggcagaactgtatttactccacagaagcattgactggaaaaggccccagtggtcaggaaaagtgcaaacttgagaaccacatctcccctgacgtccgtgtgttgccagggggaggagcccatggaagcacacgagatcagagcatctgaactgccctgccttggaggagagacttttgggtgaggtccaaagaggagagctgttcagcttacctgccacagagcttttctgcatgaactctggaacagaaaggccctgtaaagccctcagagagaagagagactccagagaaggctccctaagaccttgagagccatgacaggtccatcagcatgaagttggccaagccatagggcacagcacctccttgtaacaactctatagccctctttgggagatgacatgagtggaactcacagccaccactaccaccactttagacaggaccgaggccacatactccccattctctcgtggctttccatctcagcctcggagggcaacattgacagtcctcctggcttcagctagagaaggatgctggaacaagcggctggtgttgaaagagtgggttgaccaatttggtattgaatgttgcccagccacccctaggaacacctgtccatcacctcctggatggattccactgttagacagctacagggaatgattggtcatggggaagtctctgcgccataagccacgatcccagcgcaaaacccttactcaaatgtcttcattgacttcggtatttcatagtacctgagattttattttgagataccatcagggtgagttgcaccacttgtactcaattctaattgccccctggcaatctgggaagggttcagaaggtgggcacccagccaacagcatgaactcagagcattgttttagggttggaggaggaacacgctttctttacatcactagtgtagactcaaaagatatgcaagtgtcaaatatgcaaaagaaatagtttattcaaagagactgtgtgttactgaagaacagcataaaaatatgatttttttacttgcaaaaatgaaaggaaaaaaataccacgcattgaaatgcccagttcagactgaataattcctgctgcagcaaggaaagtacctactataatagaaattctgttttgttttctgtggttttcaagttaaaaaaaaaaaagttaaaataaaaagcactttatgtttttcaaaaataggttctgccagggacagtgtcaacatcttgcactttaaaataagcactatttcccatagcccaattgttgggactgtagttggattgttgctacctgcccatttctggccagcatgggtaatattgtgctggtattactgtctgccatatcaaagtctgtgggctccttccctgcccctctgaaaccttcccttaaccctcatgggtcaggaggggttcttgccccttgggtggggcctctcatgaagtcaagtatacaggagacatgcacatctcaaaaggacacagtgacagttggacattgggtgttttactctgttctctttcttgtcaaccagctattggtttttcagtgtcactgtctgtactaaaagctcaactctccttcctgcagccatcgatgcagccagtacagacaaaagcaataagtatttgtgtgcatcctgagtggttctggtgtatttcttggtgttggttttcctgtcctcgtttgatgacctggcattgtcctgcctgcttttagtccaacagcatggtgttgttggccattcctcagtacagtggcattaggttgaaccactgatgaatacaatgctatagtgttggctcacctgtcagtaaagatgacatgttattggtctgcctgtctgtagtacaatggaacaatgttgttctcttaatgtaatgttgatggatgatgtcccaagtacaatagtgtagttctgtctatcctcaatacagtaacaggcatatgtcttcccagtggaagaaagatatggtattggttcacctagtcttaagtctcaatatcatctgttgctggtctgcctgttagtacaatggcatgatccacctctcagtacacaaatatcatggagctgttctgcctgctcttcatacataaggcataaggttgagccacctgccacacatatgatgagatgggatcattccaccacccttaaaaatatgtcttctctgctgtatacaaacccaattcataacacttctcagcatctccagagactgtagatccccccaagagggtgcagtcctgttctttgccgcattaacagagaaaacgagaacgtcactcttcctaggtatcttcagagtattcgcgcagcaactgcaaagggacttaggggcagggagagtgtgaggtcatcccgtgccaggcagaggaagcagcactcccaaaacactttgctgaacacgcagtctgagctgggggcctcttgaggaatgactgtgggacagttctccgccgaccatctcacatgtctcttctttgttttcatcaccattaatgtccaccatcagcacaaatgtgaaaattcagggaaaaaaacaaatgctttttgataaaagtaaatagttgtgatttccaattcagatatttttagagctgatgctatctgtaaaaaataataataataataatatagtctattttacatatcaggaaagtgaacatgtttcaatatagccatatatattgagaaggaacttaccaccccttcttccaatcgaggcatttcatttgttggttgaagcagatgagaactgtacagattgaaaatgatttgtttttttttttttttaaaaaaaacgaaaaccaattggtgcaactctccttgtaaccaaaggccctttctgccttctgtggtcatgtaggacctggcccttccttccttgtgtattttgtccaaccgtaaagtagcattttattgagtcacttttgaaggacgaattcagaagtatcattaagaacctaccttttcaggcttcatagccagagtcctatagagttcttatagaaacagaataattgaaattcagcatatactatgcttagaaagtattttgtttgggtttgattgggtttttttttcttttacttgtgtgtgtatgtactgggggagtatagcttttattctgtgctcaattcgaaagagagtattataagttttcccagcccatccacccgctaaaaaagaacatatccaaattttaatatgtatacacccaacctgtacctatgtacgtgaatatacatgcactgggaaatctacttaagagtcttcactgagaagttcactcgatagaaaggtcttgatagagaagagaagaggaaagcaatggtctgaaggcaaatcctgctttaacttggtggtccatttcccattcattcctgaaccaatgagagcagaaagaaacaagtcaacccaaacaagcaaactaggggctggacgcggcgaatggatgctggtcagtttggcaaattcactgaaactcatcaagaacccagctgaacttgcattccaacttccacaattatctgaaagggctagggaccaggtagccatgtgtcccaatcacacgggggagagtctgccaccggcggtgagagaggtggggaagctttggaggagacagtatattcacctttttatctttgggtaaaagaaaccaacaggactttggtgcagtagatttctcagtgccttctttaggaattctatcttaagcacacttcaaggggaaagaaaaaaggaggagagaacatttgttcccgtgaagtccctttctccaaaggactggggatcaagaaggaagaagagtaagaaggaaaaacaacaaaatcctgaggaggccatttcttttaacccacccagcttgcccctgaaaactgctggtgatacaaactttttcaaactgacttccagcttctccatgtgtcttggtaactgtagcctcgtctctgccctttctcctaataagatccatgtttctaaggagaaaaacaaaacagtattctcttctgtaaaactgtaatgtattgttgatatttgtaactattgtatatttctgtcttgctccagtcccagctggagtgtctagttccatggacaaggggatatttaaaattcaccacggacaagagccactaaagccaggtctctatcgctaatctctctcctattcttatttctctaccaactaatctcaagtaacaataccccaggctttttttcagcctcaattcaagtaactttgaatcaaaagagagcaaggcaaaaagcctccggacatgcttctttgggaaaggactttttctgtagctgcagagtgggcaggagggagaaggggctcccctgagaccccggcaggacaatggaaagcttccagccccgagctgatgtttcctcacctatcactgcttataggacagcatccaaatgctttcatgtcactcagcccaggcaacccaaaccagtcctggctacacccagaaataagagttacctctgcattttctgttgccatttttctggctctagaagtatctgatgcgcgactatgtcatagaatgtccacgcatctcagagtagtctatttttctgttcagataaaatatatatatatatgtatttttagcaaatttataatagggcaattgagtctaatttcttcttttgtaatacagaacaatatcttaggagtttca

SEQ ID NO: 23303 - DNA, 3457 bp, Homo sapiens
cgggatggaggtgagaagacggccgtgacgcggctgggcaagctccgcgactgcaacacgcacgactcgctgctcgaggtgtgcgatgactacagcctcgacgacaacgagtacttctttgaccgccacccgggcgccttcacctccatcctcaacttctaccgcactgggcgactgcacatgatggaggagatgtgcgcgctcagcttcagccaagagctcgactactggggcatcgacgagatctacctggagtcctgctgccaggcccgctaccaccagaagaaagagcagatgaacgaggagctcaagcgtgaggccgagaccctacgggagcgggaaggcgaggagttcgataacacgtgctgcgcagagaagaggaaaaaactctgggacctactggagaagcccaattcctctgtggctgccaagatccttgccataatttccatcatgttcatcgtcctctccaccattgccctgtccctcaacacgctgcctgagctacagagcctcgatgagttcggccagtccacagacaacccccagctggcccacgtggaggccgtgtgcatcgcatggttcaccatggagtacctgctgaggttcctctcctcgcccaagaagtggaagttcttcaagggcccactcaatgccattgacttgttggccattctgccatactatgtcaccattttcctcaccgaatccaacaagagcgtgctgcaattccagaatgtccgccgcgtggtccagatcttccgcatcatgcgaattctccgcatccttaagcttgcacgccactccactggcctccagtctctgggcttcactttgcggaggagctacaatgagttgggcttgctcatcctcttccttgccatgggcattatgatcttctccagccttgtcttctttgctgagaaggatgaggacgacaccaagttcaaaagcatcccagcctctttctggtgggccaccatcaccatgactactgttgggtatggagacatctaccccaagactctcctggggaaaattgttgggggactctgctgcattgcaggagtcctggtgattgctcttcccatccccatcatcgtcaataacttctctgagttctataaggagcagaagagacaggagaaagcaatcaaacggcgagaggctctggagagagccaagaggaatggcagcatcgtatccatgaacatgaaggatgcttttgcccggagcattgagatgatggacattgtggttgagaaaaatggggagaatatgggtaagaaagacaaagtacaagataaccacttgtctcctaacaaatggaaatggacaaagaggacactgtctgaaaccagctcaagtaagtcctttgaaaccaaggaacagggatcccctgaaaaagccagatcgtcttctagtcctcagcacctgaacgttcagcagttggaagacatgtacaataagatggccaagacccaatcccaacccatcctcaataccaaggagtcagcagcacagagcaaaccaaaggaagaacttgaaatggagagtatccccagccccgtagcccctctgcccactcgcacagaaggggtcattgacatgcgaagtatgtcaagcattgatagtttcattagctgtgccacagacttccctgaggccaccagattctcccacagccctttgacatcactccccagcaagactgggggcagcacagccccagaagtgggctggcggggagctctgggtgccagtggtggtaggtttgtggaggccaaccccagccctgatgccagccagcactctagtttcttcatcgagagccccaagagttccatgaaaactaacaaccctttgaagctccgagcacttaaagtcaacttcatggagggtgaccccagtccactcctccccgttctagggatgtaccatgaccctctcaggaaccgggggagtgctgcggctgctgtcgctggactggagtgtgccacgcttttggacaaggctgtgctgagcccagagtcctccatctacaccacagcaagtgctaagacacccccccggtctcctgagaaacacacagcaatagcgttcaactttgaggcgggtgtccaccagtacattgacgcagacacagatgatgagggacagctgctctacagtgtggactccagcccccccaaaagcctccctgggagcaccagtccgaagttcagcacggggacaagatcggagaaaaaccactttgaaagctcccctttacccacctcccctaagttcttaaggcagaactgtatttactccacagaagcattgactggaaaaggccccagtggtcaggaaaagtgcaaacttgagaaccacatctcccctgacgtccgtgtgttgccagggggaggagcccatggaagcacacgagatcagagcatctgaactgccctgccttggaggagagacttttgggtgaggtccaaagaggagagctgttcagcttacctgccacagagcttttctgcatgaactctggaacagaaaggccctgtaaagccctcagagagaagagagactccagagaaggctccctaagaccttgagagccatgacaggtccatcagcatgaagttggccaagccatagggcacagcacctccttgtaacaactctatagccctctttgggagatgacatgagtggaactcacagccaccactaccaccactttagacaggaccgaggccacatactccccattctctcgtggctttccatctcagcctcggagggcaacattgacagtcctcctggcttcagctagagaaggatgctggaacaagcggctggtgttgaaagagtgggttgaccaatttggtattgaatgttgcccagccacccctaggaacacctgtccatcacctcctggatggattccactgttagacagctacagggaatgattggtcatggggaagtctctgcgccataagccacgatcccagcgcaaaacccttactcaaatgtcttcattgacttcggtatttcatagtacctgagattttattttgagataccatcagggtgagttgcaccacttgtactcaattctaattgccccctggcaatctgggaagggttcagaaggtgggcacccagccaacagcatgaactcagagcattgttttagggttggaggaggaacacgctttctttacatcactagtgtagactcaaaagatatgcaagtgtcaaatatgcaaaagaaatagtttattcaaagagactgtgtgttactgaagaacagcataaaaatatgatttttttacttgcaaaaatgaaaggaaaaaaataccacgcattgaaatgcccagttcagactgaataattcctgctgcagcaaggaaagtacctactataatagaaattctgttttgttttctgtggttttcaagtt

SEQ ID NO: 23304 - DNA, 3582 bp, Homo sapiens
cgccgccgctgcgcctcgggcagccccagcgagcggcaactcccgggctggcgcggctcgctttctggctccttccgcgcggcgagctcagccccgctcgatttttcctcttctgttccagccctctcttgtctgggtggctgtggcggcggcagggggatggggaccccgtgtggggaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagccggggagaccctcctctctgtggaggggagggggatttccagcgacaggtcattggcgaaggggatcgtcgcggggagaggctccccggagggagcggggaatcccacagccctttgtggtgcccgagcccgtgccgcctgctgagcggggtctgtgggagctagctttgtcagtggaaatgcctgccccagagggatattgcttcagttgacctcattttttaaggaccctggctctgcggctttgtccagttcaaaatggcagaaaaggctcccccgggcttaaacaggaagacttcaaggtcgacactttcccttcctccagagcctgtggacattatccggagcaaaacatgctccaggagagttaagatcaatgtggggggcctcaaccacgaagtcctgtggagaacgctggacaggctgcccaggacgcgcctggggaagcttcgagactgcaacacacacgagagcctcctggaagtgtgcgacgactataatctgaacgagaacgagtatttctttgatcggcatccaggagccttcacttccattttaaatttctaccggaccgggaaactccatatgatggaagaaatgtgtgcactttcgtttggccaagaacttgattactgggggattgatgagatctacttggagtcctgctgccaggccagatatcatcaaaaaaaagaacaaatgaacgaagaactgaggcgagaggcagagactatgcgagagcgagaaggagaagagtttgataatacctgctgccctgataaaaggaagaaactgtgggacttgctggagaaacctaactcatcagtggctgcaaagatcctggccatcgtgtctatcctgttcattgtgctttccaccattgctttgtctctcaatacgctgccggagctgcaggaaacggacgaatttggacaactcaatgacaaccgccaattagcacacgtggaggctgtgtgtattgcatggtttaccatggagtaccttttgcgattcttatcctcaccaaataaatggaagttcttcaaaggcccactgaatgtcattgatttgctggccatcttgccgtactatgtcaccatttttctgacggagtccaacaagagcgtgctgcagttccaaaacgtgaggcgcgtggtccagatcttccgaatcatgcgcatcctcaggatcctgaaactcgccaggcattcgacaggcctgcagtctctgggtttcacccttaggcggagttacaatgaattgggcttgttgatattgtttctggccatggggataatgatattttccagcctggtattttttgctgagaaggatgaagatgctaccaagttcaccagtatccctgcatcattttggtgggccaccatcaccatgaccactgttggctatggtgacatttaccctaaaacattactagggaaaattgtgggaggtctgtgctgtattgctggggttctggttattgcccttcctatcccaattattgtgaacaatttttctgagttttacaaggagcagaaacgccaagagaaagcaattaaaaggagggaggctcttgagcgggccaaaaggaacggaagcatcgtttctatgaacttaaaagatgccttcgctcgaagtatggaactgatagatgtggctgttgagaaggccggagagtccgccaacacaaaggactccgccgacgataatcacctgtcgccaagccggtggaagtgggccaggaaggctctgtcggaaacaagctccaacaagtctttcgagaataagtaccaggaggttagccaaaaagactcccacgagcagctgaacaacacgtcttcctccagcccacagcatctgagtgcccagaaactggagatgctatacaatgaaatcaccaagacacagcctcattctcacccaaacccagactgccaagaaaagcctgagaggccatctgcatatgaagaagagattgaaatggaagaagtggtgtgtccacaggagcagctggccgtggcacagaccgaggtcattgtggacatgaagagcacctccagcatcgacagcttcaccagctgtgccaccgacttcacagagacagagagatcgccgctgccgccgccctccgcctctcacttgcagatgaagttcccaaccgacctcccagggacagaagagcaccaaagagctaggggccccccgtttctaactctatccagagagaaaggacctgctgccagggatggcacgctggagtatgccccagttgacataactgtgaacctcgatgccagtggctcccagtgtgggctacatagtcctttgcagtctgacaatgccaccgacagtcctaagagctctctaaaaggcagcaacccactaaagtccagatccctcaaagtgaactttaaggaaaatagaggcagtgcaccacagaccccgcccagcacagccaggccactgccagtcaccacagctgacttttcgctcactaccccgcagcacatcagtaccatcctcttagaagaaaccccctcccagggagacagacccttgctgggcactgaggtttcagcgccttgtcagggaccttccaaagggctgtcccccaggtttcccaagcagaaactgttccctttctcttcaagagagaggaggagcttcactgaaatagatactggtgacgacgaagacttcttagagctcccaggggcaagggaggagaagcaggtggactccagcccaaattgctttgcagataagcctagtgatgggagagaccctttaagagaagagggcagtgtgggctcttcctccccgcaggacacaggtcacaactgtaggcaagacatttaccatgctgtgagtgaagtcaaaaaggacagtagtcaagaagggtgcaagatggaaaatcacttgtttgccccagaaattcattccaacccaggagacacaggttattgtcccacacgtgaaaccagcatgtgactagttacaaaagcaataaattgaaacaaaacaaaacaaaacaaaacttgtttcttaaaaatgcggttaataatgcctgtgaactaaaaaaatgggaagccctccccaaaaaaagtgcataaaatgttatttttgcatggcatgaacagtttagcttaagtactgtttaaataatgagtcaagactgcattttgtaacaaaccaacaaaaatgactgaagaacagtgaacaaataaaaagagctctattaggaaccaa

SEQ ID NO: 23305 - DNA, 4086 bp, Homo sapiens
agttccaactgttgtgctgcagcagatttggtctgagtctgggcagagcccctttttatggagcaaccctcccgatttgttacagcaagagcctggtgcaagtgatctttgccttcccatcgcacacaaaggcaaagagctccttaaagggacctgcctgctcctccgtgcagctgcaaacccgtgtcggtgcaggctcagcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggaccggctccgcgaagggctgcgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcagaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaa

SEQ ID NO: 23306 - DNA, 1806 bp, Homo sapiens
agtgacttccagtcttctctgaaagatctccacgatgctggcagcccggacaggggcagcggggagtcagatctcagaggagaacaccaagttaaggagacagtctgggttttctgtagcagggaaagacaaatctcccaagaaagcctcagaaaacgctaaagacagcagccttagtccctcaggggaaagccagctcagggcgcgtcaactggctctgctgcgcgaagtggagatgaactggtacctaaagctctgcgacctgtccagcgagcacaccaccgtctgcaccacaggcatgccgcacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagtttt

SEQ ID NO: 23307 - DNA, 3301 bp, Homo sapiens
atgcacaggcctgggcagggacacacaaccaacagctctgtcgggaacttaggagcctgctcgcctacaaaaatgataagagagatctaaagaaaacaagctaaaccttttgagggacatactgaagccagataacccaaggtattcacagcaagatacagtgagtcttaaagttaagcaccgtgcaattagctttgcttccttgggtttttgaaacatgcatctgtataaacctgcctgtgcagacatcccgagccccaagctgggtctgccaaaatccagtgaatcggctctaaaatgtagatggcacctagcagtgaccaagactcagcctcaggcggcctgcaaacctgtgaggcccagtggagcagccgaacagaaatatgtggaaaagtttctacgtgttcatggaatttcgttgcaggaaaccaccagagcagagacgggcatggcatacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatctt

SEQ ID NO: 23308 - DNA, 3122 bp, Homo sapiens
agaaaaatcaattcagattactttgatgacagtgacttccagtcttctctgaaagatctccacgatgctggcagcccggacaggggcagcggggagtcagatctcagaggagaacaccaagttaaggagacagtctgggttttctgtagcagggaaagacaaatctcccaagaaagcctcagaaaacgctaaagacagcagccttagtccctcaggggaaagccagctcagggcgcgtcaactggctctgctgcgcgaagtggagatgaactggtacctaaagctctgcgacctgtccagcgagcacaccaccgtctgcaccacaggcatgccgcacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaa

SEQ ID NO: 23309 - DNA, 4273 bp, Homo sapiens
gaaatgcaaagcaggggctgtggggaaatctcaccaacccctcctcccctgggaggtggcaaaggtggtggactgggctgctgggaccctggggaggaatgaaacagaggctgtgttgatggcctgcagttccttgtaatgtggtcatcaaacggtgtacagttcccgtctgtggctgcaggctggagagctgactgctggcacagatacagcctgacctcgggtcaacacttctcggagtccagaggggttgggagtgggacaggtggcctcccagggacgcctccctgagtggccagtggtgccgcttgtccctgcacctgtagctgccctgagcacccccactggacacagtgggcattgcaccctccggagaaagctgcccttgttccacgtgcgagccctgtccccagcgccatgggctgtgctacctgcagtaacgcagactgcgagccccggctgcctctccagtgctctctctcctctggccttcagcaggctgggtcacagagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaaccc

SEQ ID NO: 23310 - DNA, 3171 bp, Homo sapiens
gctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcag

SEQ ID NO: 23311 - DNA, 3129 bp, Homo sapiens
gctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcag

SEQ ID NO: 23312 - DNA, 4142 bp, Homo sapiens
acttcccgagcttttaggggaagaggcactcgtgaataattcagcctctttcactgagatgaaaacgccctaatagaactaatggactcgctgcctcaaaactcgactctggtgggactcatctcattcaccaattgcttctgacgtcctgcagtgacactccctaatgaaaaagccgctgtgccagatccttagagtgtctggtgatccctaataaaccagactgtggcctttttaacgagcagacgcccccacgaaggcagtggcagctcccaagccaggcggcaccatgctgtccatgacgtacagcgagagtctgcggagcgtgagcagcaggtgccactctgaatgggccctgcaccccgtccgccagacggacacgctggaactgcagcggctgcgggaggtgcgggcggctgcccaggccaggaacatggagagcttcctccgcatgcacggcctttccctggacggctgcaccgcccagcgcacaggcatgaagtatcggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaaggggacccatttagttcctccaagtcaaggacattcatcatagaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaaccc

SEQ ID NO: 23313 - DNA, 700 bp, Homo sapiens
gctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggagccagcagggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctag

SEQ ID NO: 23314 - DNA, 1202 bp, Homo sapiens
agcgggattcgggggcgctaaagtcgcaggggcagggcgggaaggaagatccggcgcggggcacaggatccggagctggagcccccagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaa

SEQ ID NO: 23315 - DNA, 4201 bp, Homo sapiens
ggaccgaggactggccgaggggcgcgccccgtccgctgccacccgcgggaggagcctcggaaggcggcgcaccgcgccgcacactcagtccaagaacccgcctcgcgtcactgtcgccgtcagggccgcggagccaatcagagcccaagtcgagggctgcgctttgcgagcgccagccaatcggtgcggcggcgggcccatcctgatttgcatgtccgacgacccctcaaccaatggtaatgtgactggcgtgaacaatagccaatcagaagctggaagaggcgtggccccgggcgtcccacgaggtgaagatgctgctggcggaacctgcaggagctagcgggattcgggggcgctaaagtcgcaggggcagggcgggaaggaagatccggcgcggggcacaggatccggagctggagcccccagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggtctctgtga

SEQ ID NO: 23316 - DNA, 822 bp, Homo sapiens
agacgtccaccaaagccacacatcgcgacacacggaggcagaaagcagcggtctcctaagaagttagacacgaggaatctcgggcagcgagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgg

SEQ ID NO: 23317 - DNA, 959 bp, Homo sapiens
agtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaa

SEQ ID NO: 23318 - DNA, 961 bp, Homo sapiens
agtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagg

SEQ ID NO: 23319 - DNA, 500 bp, Homo sapiens
ggggcctgggtgtgcggctatggggactgaactgtcgagggctcctgctgcctctgcaggggacaggccctgccagctactgagtgagcagcctgcggcagccctgactcactgcgggtcgtgccgtctgtgcagcactggggtacccaccacccagtgccagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggagg

SEQ ID NO: 23320 - DNA, 486 bp, Homo sapiens
gggggcgctaaagtcgcaggggcagggcgggaaggaagatccggcgcggggcacaggatccggagctggagcccccagaggcctcacgacaggactagtgccttggtaagaagaggaaaaggccagagctccctccctaccctgtgtggacccagcaggaaggaattctgtctgcaagagagagccctcacctggaaccaaatcagccaggaccctgatgttggatttaccagcctccagcaccgtgagacagaaacgtctgctgtttcagccacccagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcct

SEQ ID NO: 23321 - DNA, 1336 bp, Homo sapiens
agagtgtctggtgatccctaataaaccagactgtggcctttttaacgagcagacgcccccacgaaggcaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagacca

SEQ ID NO: 23322 - DNA, 2458 bp, Homo sapiens
atgcaggtgtctatcgcgtgtaccgagcagaaccttcgcagccggagcagtgaggaccgtctgtgtggaccccggccgggccccgggggcggtaatggtgggccggccggcggggggcacgggaatcctccggggggtggagggtctggccccaaggcccgagctgcactggttccccgacccccagcgcccgctggggccctccgagagagcaccggccgaggcactggcatgaaatacaggaacctagggaagtctggtcttcgggtatcctgtcttggcctaggtacctgggtcacatttggttctcagatctcagatgagacagcagaggatgtgctgactgtagcctatgagcatggtgtaaacctgtttgacaccgccgaagtgtacgcagcaggaaaggctgaaagaaccctagggaacatcctcaagagcaaaggttggaggagatcaagctatgtcatcactaccaagattttttggggaggacaggcagaaaccgagcgaggtttaagccgaaagcacatcattgagggcttgcgaggatccctggaacgcctccagctgggatacgtggacattgtctttgccaatcgctcagaccccaactgtcctatggaggagattgtgcgagccatgacctatgtcatcaaccagggcctggccctatactgggggacatcccgatggggggctgcagaaatcatggaggcctactccatggccagacagttcaatctgattcctccagtgtgtgaacaagcggagcaccatctgtttcagagggagaaggtggagatgcagctgccagagctctaccacaagattggagttggatcagtcacttggtaccctctagcctgtggtctcattactagcaagtatgatgggcgagtcccagatacttgcagggcctccatcaagggctaccagtggctcaaggacaaagtgcagagtgaagatggcaagaagcaacaagccaaagtcatggaccttcttcctgtcgctcaccagctgggctgcaccgtggcccagcttgctattgcgtggtgtctccgcagtgagggtgtcagctctgtcttgctgggggtgtcgagtgcggagcagttgatagaacacctgggcgcgctacaggtgctgagccagctgaccccgcagacagtgatggaaatagacgggctcctgggaaacaagccgcattccaagaagtagtctgtcgcgggcgcagggacccaacccggtgtcgctgcacccgcccgagccccgctcctcgcagccgcctctcccgctccggatccctccacgcagcggccggagccagactagccccgcccaccaacgagtcccggcttcgagtagtgatacgcatgaacaaagccatatccttttgcagtggggtcgagagagaaagtagcacgcccgccccctgctgcgtctttctaggcccttcttgcaaatcccgggcatgagctactcgccgtcggctctctgccacttcgtctcgctccctactctcctccccttattcccgaggcccagaaaagaaaacaaaaacaaaaacccagcacatacaagaaacatacagtgtacctcaaaaggggcccttgaaatgtcatcaaagggtaataacctagtgagtgagttgtgatgtcatctggaacataggaaatggggctcttagcgtattcggtacgaaggaagccaggctggtcctggcaggaagtaaatgataatctttgggaaaccaggaccctgcctcccagcccagaggtggaggagggcggtcagggtggggtctacagtggcacagcactgacaaaggtagagggaaatgtaatagcacatctacgctgcagtctggtgaaagtggccggggtggtccttggaaaacagttgggctgttcttggcaggaattagtgacagcctttccgtcacgggcagggacgccttgatttaaaaaaaataaataaataaaacgtctgggtatagacttttgagccttgagcagggcctcctacctggcagtggggaactgcagtcttcctcctggcaataaacctaaagcaataatgatggccccttctctgtaagacttcccaggtaactgtaaataaacctcagcttgatcctcacagtgtctaaagttgcaggggcttgggaggttagggtcacagtctcacttgtctggccctctcgccccctaacattagaaatctgctagcattagctttctctccattgctcattcaccttggtgacccaggcatcgggctcctagtcactgttctcatcaaggaccaagacaccagataccccaggccccagttttcttccttcagctaccacattccttagaacccagaaatctggcttcataattttgttcctcctctttctatgaaagacttagctatctgcctttatttgtttgtatttaaagtaatattagccata

SEQ ID NO: 23323 - DNA, 1488 bp, Homo sapiens
atgacggtgatgtctggggagaacgtggacgaggcttcggccgccccgggccacccccaggatggcagctacccccggcaggccgaccacgacgaccacgagtgctgcgagcgcgtggtgatcaacatctccgggctgcgcttcgagacgcagctcaagaccctggcgcagttccccaacacgctgctgggcaaccctaagaaacgcatgcgctacttcgaccccctgaggaacgagtacttcttcgaccgcaaccggcccagcttcgacgccatcctctactactaccagtccggcggccgcctgcggaggccggtcaacgtgcccctggacatgttctccgaggagatcaagttttacgagttgggcgaggaggccatggagaagttccgggaggacgagggcttcatcaaggaggaggagcgccctctgcccgagaaggagtaccagcgccaggtgtggctgctcttcgagtaccccgagagctcggggcccgccagggtcatcgccatcgtctccgtcatggtcatcctcatctccatcgtcatcttttgcctggagacgctccccgagctgaaggatgacaaggacttcacgggcaccgtccaccgcatcgacaacaccacggtcatctacaattccaacatcttcacagaccccttcttcatcgtggaaacgctgtgtatcatctggttctccttcgagctggtggtgcgcttcttcgcctgccccagcaagacggacttcttcaaaaacatcatgaacttcatagacattgtggccatcattccttatttcatcacgctgggcaccgagatagctgagcaggaaggaaaccagaagggcgagcaggccacctccctggccatcctcagggtcatccgcttggtaagggtttttagaatcttcaagctctcccgccactctaagggcctccagatcctgggccagaccctcaaagctagtatgagagagctagggctgctcatctttttcctcttcatcggggtcatcctgttttctagtgcagtgtactttgccgaggcggaagaagctgagtcgcacttctccagtatccccgatgctttctggtgggcggtggtgtccatgaccactgtaggatacggtgacatgtaccctgtgacaattggaggcaagatcgtgggctccttgtgtgccatcgctggtgtgctaacaattgccctgcccgtacctgtcattgtgtccaatttcaactatttctaccaccgagaaactgagggggaagagcaggctcagttgctccacgtcagttcccctaacttagcctctgacagtgacctcagtcgccgcagttcctctactatgagcaagtctgagtacatggagatcgaagaggatatgaataatagcatagcccattatagacaggtcaatatcagaactgccaattgcaccactgctaaccaaaactgcgttaataagagcaagctactgaccgatgtttaa

SEQ ID NO: 23324 - DNA, 7983 bp, Homo sapiens
aaatggaccgagcggacccgccgccgcacgcaccctgctccactccaagctcctaagggctcctggcgcgccgcgtagccttggcgaggtccgcgctggggtgcggagagcgaagggaactggagagccatgtagatccaggctctcgcccgcccgcctccttcgggatcgaatcaagggctcccatagtgttaggagggggcgagagtgctgtttatcgtcatttgcctcggagcttcgagagagggtggtattttgcttttccgccccgcatcctccggaactccctgcaccggagagaggacggcgtctccaggttgctggcaaccggtgagaatgggggtagggaaggaacattttcgccgtagctgctccgtaaagcgattgtccaactgagaggggcgtcggacgagtggaccagggcggcgagtttgcccggcgcgtctcggatgctgctgcggcggccgccgcggctcccgccagggcactgcaaagacgacctgccgcattcccactcgggctctccgctgactcagcaccgcccctgcgccaagccagccggccagcgtgcatcgatcgccctggtgggagcttagaaggcggcaggcgaagaggggtaggaggggggagagccgaggagaagcagagagggtggcaggcgtggggatctgccgagccggcactgcaccgggtcctaggaaggctctcggaggggaggggaggccagggcgacccccgaagcaatggcccagtccgctagaacggcactgcgttaaggcacctgggatcaggaagaaatatctaaacaacaacaacagaaaaccaacaaacccccaaacccaaacccaaccctctgcaaaaagctgcacccggcccgcaggcgagggggattccaaactgagtgaaaggcagggtggaggggaaggcagcgagaggcaaagtcgcagatctcccgacctgctcgtgttgaagcacctccccctgggcgtgagggagacgcgcgctccggtgggggggccgcttgggtcccccccacccctggtccctggctgcttcccaccccgggctctctcctggcctcccacccccgcgcccggcttccaccatgacggtgatgtctggggagaacgtggacgaggcttcggccgccccgggccacccccaggatggcagctacccccggcaggccgaccacgacgaccacgagtgctgcgagcgcgtggtgatcaacatctccgggctgcgcttcgagacgcagctcaagaccctggcgcagttccccaacacgctgctgggcaaccctaagaaacgcatgcgctacttcgaccccctgaggaacgagtacttcttcgaccgcaaccggcccagcttcgacgccatcctctactactaccagtccggcggccgcctgcggaggccggtcaacgtgcccctggacatgttctccgaggagatcaagttttacgagttgggcgaggaggccatggagaagttccgggaggacgagggcttcatcaaggaggaggagcgccctctgcccgagaaggagtaccagcgccaggtgtggctgctcttcgagtaccccgagagctcggggcccgccagggtcatcgccatcgtctccgtcatggtcatcctcatctccatcgtcatcttttgcctggagacgctccccgagctgaaggatgacaaggacttcacgggcaccgtccaccgcatcgacaacaccacggtcatctacaattccaacatcttcacagaccccttcttcatcgtggaaacgctgtgtatcatctggttctccttcgagctggtggtgcgcttcttcgcctgccccagcaagacggacttcttcaaaaacatcatgaacttcatagacattgtggccatcattccttatttcatcacgctgggcaccgagatagctgagcaggaaggaaaccagaagggcgagcaggccacctccctggccatcctcagggtcatccgcttggtaagggtttttagaatcttcaagctctcccgccactctaagggcctccagatcctgggccagaccctcaaagctagtatgagagagctagggctgctcatctttttcctcttcatcggggtcatcctgttttctagtgcagtgtactttgccgaggcggaagaagctgagtcgcacttctccagtatccccgatgctttctggtgggcggtggtgtccatgaccactgtaggatacggtgacatgtaccctgtgacaattggaggcaagatcgtgggctccttgtgtgccatcgctggtgtgctaacaattgccctgcccgtacctgtcattgtgtccaatttcaactatttctaccaccgagaaactgagggggaagagcaggctcagttgctccacgtcagttcccctaacttagcctctgacagtgacctcagtcgccgcagttcctctactatgagcaagtctgagtacatggagatcgaagaggatatgaataatagcatagcccattatagacaggtcaatatcagaactgccaattgcaccactgctaaccaaaactgcgttaataagagcaagctactgaccgatgtttaaaaaacaaaggcaagcaaacaaaaaagccccacttagcagctcaaaagacttaaaaaacaaaacagaaaacctagtgactcatgtcacgctttgtagatactttactaagtagacttggaatgctctatttaactgtcaatgcgttgttgcattgaggattttgggggtggtgaaccagaagctttcaagatccatgacaaaataaactattttccttttattaaaaaatgggaaaagagagagtattttctaaaactggcttaaaaagattcagtccacgaactagtctaggtaaaataataatcatatgcttccccaaactgaaacatttttaatgctttggtttctttaacttttttaaaaactcagaacaagatgatcacttagaaatatgaaattgaaattcgcatgggactccagtaaaacatctttgcaaactgcgtagcacattgaagacagtgcatcagatgtattatatgtaacatgatagaccagccaaaatggacaatgaatagatatttttatttcgatcaactgaactgcatattacaaggtgaaaaaagaaaactccgattacttaagactggttcacaaagcaccttataaattggatactggtcctgatctgtagggatttccccctgggcccattctctttctaatccagattattctctaagaaaaagttaactgaattaaattaattgattcttctgcagtgccgctaaatggtctcaactgcagatgagccaaatacaggtcttttctcaccaggcctgcactccgacccctggctttcagaactggatgtaaaaccttagcctccttattgcaagagagcacaaatgaagttaaatgtaagcatgtttgaatctgatacaatttattttataatcgcatgctgagaagttaacccagacaataggggataagcttaagttgaaatcgattcttctaaaaatagatcctttttcatttgcattcaccaaaagtgcactcctccatttattaactattttattagtaaataaagtactgtatttaagtgcatatgttagtcagatgggaacaataactttttggagctcaaagcatgttctcttattcagcattatggcctatttgactaagatgtaccttgaattaattaatgcatgatttcagtaataaaaattttaaaagtaataaaaattacaagtctgtggggtgaaaggcccaatagaaattatggggggtgggggtgggggcactcagtcaattttcctgcctttgctcagggaaataccaggtttttgtgcaggtataggcggagagaggaccaatatgcccatcccttaaagggaagccatgtgaaaaactcaataagtcatcaaagtacatatagcaacacctaagaacaagtattctttctagctgaagacaaacacaagcaacacaaacaagcaaacaaacaaacaaacaaaaaggtgcaatactgcatgttttttggtgcattcttaggatgtaaatgaaaatgtttctctattatatgcatccgaagcagagctgatttttttttctttgcagtcattctttgaagtctgtagagacttcagccctccccttgaggctccctgaagaaactaaaccaattgatttaatagttgcttagtgcctttatcctgtacccacagtgaactgtagaaagtgcctccttaacacagctgagaagttaggtagcaaaagtggggaagggttggggcacagaccttttgctttttctttttccattctcgctctctcatttcaccactgtgagaagaccacaccaccctaaaccctggagaggagagacccaggagggtgctgtctctctggccatctactagcattggtccctttgacagcctgacgctggatgtgaactgagacccatctttgaactggacatgaactgtgaacttgttttttcctctctccaccaaagccaagataaactttttgggaatttgtttcctatcgagggccactttggacacacaaggcttcctcaggtccagtgtagtgctcctggcacctttccttatttttttctctgtcggtaacagcactttgcaaatctctctgacggtccagtcttttcaggcattgttgtggatgtgggaacactcagttcataataacctttcctaggccttccctcctggtctacccctttcagatatttcctgatgcccctatgatcttcccacctggcagtcacttcacaggttgaacatctaacttctgctgcccccccgttacccagcccagagaatggtggggaccctgttcctggctgaaagagagccacggaacacaggcctctggagctcggcagctgcccaccggtggagaggtactcacagcctttcaaaggaccctgaggtggggaatcttcattctgcacttagcatgtggctgcctgttacctgacattctggcccagcttcttctgaaaatctgtcctgcttctcccacccctttcccccatcctgtcctagaactagcagtgaggcaatcaccctagaaactcgagttacacccattctggctaactcgattaaaagaaagaacatggatatcttattttcctatgtgacttttgtgaatctgtgagatgaacacaacacacatcgtggaagatgaggggccaagaactgcgcagcatccgactacagggcattaaaccctcccatgtgatgtctccttctcgtctgaaccttaactcattctggcgattcctttcctacttgcttaaaaatccccaattaggaaaaaaatgccaacctcctcccaggcttggggttatcttgatctttcatttcaacgttgaggtctagtgcacacagaacttgaaacaccgcactctgtcaacagcaataatccactcagtactgtgggatggatgggttaatggatgagaaaacggcaccaagactgactttgggtatttggtatatttaccgtggttacactctggactggttgattcttctgcatgtgatatagaaaaaagtgctgcatgcggtgaacctgtcagtctgggactgggggtgagttgttgttatgagtttggggtggtgtgaggaaagtgaatgctgcttagctcatctgtagctcattgcaatgaattcagtaagaatggagtacagggattatctgtgtagcataggcatgcaatgtttgaccaagctcttaccctcgcactgtaatgtgttgaaatgtctttgtagacctgaaggtgcacttaacaaaactgcctattaagggatgactattttttggtttacttattcatatttattttagcagcctttttaccttttcttccccttcctaggcatggagctgtaacagctcatgtcctgactatgtgttttctccagaaggagaagacttctgatgtgctgatagctataattcctctcttccagtctattggggccctagttcaatagggtggcaatagaagagttggtcacaccagggctgttagccatcccagaatctctgaagtggttaactcacctgaagtgatctgaatcagagagaccaaagacattcatttcctctgtcctcagatttctagaagacaaattctagccaggaaaactttctgtttttgcatctcccttttcccatttgtgcccaactccccttgcactccctggagacttgagttctgattttcagttatatcagctcattgggagtgtgttcgtgggtgagccttgcagaatcagataaaccaatagcaagtccttctccaggattctggccagtgggcagtcatttccctgaaatgaattgtagggcaggtttagattccactatggtggacgtgaagcacaggtggtgtcacaatcttgatttgcttgagaattaaaaaaatacatgtaaatggtaaatgaggaatacatttttttaaagtagaaatttggtttagcctataaaaggccttcttcacattgtgtatagttacacgtttttcaaattaggtaccatctaaaagtcaataaaaatagtttcctagccctctcatttaatataggagacctcaaaacacatgctttttaacaattttacattttaattcttagtttggtagattggattgaaagaaaggagaaagaacattagcagaaggcactttcccattttcttccaggaatgacttattcctggggtggtgagaattggtgggtggtaaccatccatagtataaaattgttagaaagaatataaactgccaaacaagcatgttatcttcaggcttttccaagcaagaatgaagtcttttgatgtttatgttcattttaagaagacaaacaaactaaaattttaagaccagacacaacccaagttgaattgtgatctcaggaggtgaactctcattcaccatgtggcatattactacctgtatttatatcatggaatttcagggtatatgtgaacatgtctagtatgactcaggtaaacctttaaagaatgtatgttacttaccatttttgtaaagaagcaaacaggagctgaattgttaaccaaaactgttccattaccttgggtcactgtgcaaactaattcagggtacagatataaagtttagaagccttgggattaaatgccagcctctttgctcaggcaaaatgaccctgggctttcttgggaagtccagcatgtatgtaaggggtgaggccctgctgacctcagggcttttcgctttaaggagattaaccctagtcacagtgattttcatttaggagctaactaggagtttactctttatgacgtgaaacttcaaagagtatagaaaacttttgtaccacaatcaaagaagaagaaatggtgtatggaaagaaaacaaaacaaaacaagaaatctcttgtaaaatattccaggtcaaagttgtctcctctccaaaccttgcagaagcacctttcttctcttcagcgcactgttttgggactgtttatgcagcagatgtaagtagacaacatggactccatgtgacatgcctctaatagtaaagataaagtattactgaggttaaaaataaaaattgagtagtattaatttaaagtgcaccatcaggacaacaaaccatttaagctgaaaaaacgctattttatttcttgagtttgccagttgcttccaccttgagttaaggacgtgtctcatcttcacctactgcgcattctcccttctctaactgtgtaatatgtcaggtcaaggacattgaatgttatgaattgagaacctaattgatgcgcatagttttcatctatgcaattttacttgcttctgtcactttacgatctgttcatatttggcatcaattaaagatactttttaaggatcttatcaaggaa

SEQ ID NO: 23325 - DNA, 1959 bp, Homo sapiens
acaagatcatgctttttattattaaggaatgttaacttcctcttttagtatggcccctctgccatcacatatggagaccatcctttgctggggagaatctccccttctttgccaggatcctttttttgcaatttctcctagttattagtttatgcaaactcaggggtacaaaatgattttaagggaagcatgctgccaaaataaccatgacgttccttcccaagctacaaataagtcattgattagcccattggtgtaccttacctcaataaacaagggccagttgtattctgccctggatcttgtataatgaacttcttcttctccatagctcacagcaggcagtgaaggctgaggatcttcatgcttcttccctggctcccctagaatggatgtgtgtggctggaaagaaatggaggttgcgctggtcaattttgataattcagatgaaatccaagaagagccaggctatgccacagacttcgactcaaccagcccaaaaggccggcctgggggcagctccttctccaacgggaagatcctcatcagcgaaagcaccaaccatgagacggccttctccaagcttccgggagactatgctgaccccccagggcctgagccagtggtcctaaatgaaggaaaccagcgggtgatcatcaacattgctgggctgagatttgagacccagctcagaacccttagtcagttcccagagactctcctgggagaccgggaaaaaaggatgcagttctttgactccatgagaaatgagtatttctttgatcggaaccggcccagttttgatggaatcctatattattaccaatctggtgggaaaattcggcgcccagccaatgttcccattgatatctttgctgatgaaatctccttctatgagctgggtagtgaggccatggaccagttccgggaggatgaaggcttcatcaaagaccctgaaacactgctacccaccaatgacatccaccgtcagttctggctcctctttgagtaccctgaaagttccagcgctgcccgtgctgtggccgtggtctcggtgttggttgtggtcatctccatcaccatcttctgcctggagacactgccagagttccgggaggatagggagctaaaggtggtcagagaccccaatctcaacatgagcaagacagtcctctcccagaccatgttcaccgaccctttcttcatggtggagtctacctgcatcgtgtggttcaccttcgagctggtgctccggttcgtggtctgccccagcaagactgacttcttcaggaacatcatgaacatcattgacatcatctccattatcccctactttgcaactctcatcacagagctagtccaggagacagagccgagtgcccaacagaacatgtccctggccatcctgaggatcatccgcctggtgagggtcttccgcatcttcaagctctcgcgccactccaaggggctgcagatcctcgggcaaacactgaaggcgtccatgcgggagttggggttgctcatcttctttctcttcattggagtcatcctcttctccagtgcagtctactttgctgaggtggatgagccagagtcccatttctctagcattcctgatggcttctggtgggcagtggtcaccatgacaactgtaggctatggggacatgtgcccgaccaccccaggggggaagattgtgggcactctgtgtgccattgcaggggtcctcaccattgccctccctgtgcctgtcattgtctccaacttcaattacttctaccaccgggagactgagaatgaagaaaagcagaacatcccaggagaaattgaaagaatcctcaacagtgtaggctcaagaatgggcagcacagactctcttaataagaccaatggtggctgttccacagagaagtctaggaaatgatcagtccagggcttcttgggtccatcctgtctctc

SEQ ID NO: 23326 - DNA, 3346 bp, Homo sapiens
gcggaggcgggcgcgcgccccgcaggggagggggcggagagcgcgagaaggagggaggaggcgtccccgtgcgggagcccggctgaccgcgccagacccagacagagcatcgcggctttggctgcaacaggcggtgggctcggctcgggggcggaggcggcgaaagggcggggagcgcgaggaggagcgacctggcctcaccgctgccgcctcttccccgccgcatggacgagcgcctcagccttctgcgctcgccgccgccgccctcagcccgccaccgcgcccaccctcctcagcgcccagcgagcagcggcggtgcccacacgctggtgaaccacggctacgcggagcccgccgcaggccgcgagctgccgcccgacatgaccgtggtgcccggggaccacctgctggagccggaggtggccgatggtggaggggccccgcctcaaggcggctgtggcggcggcggctgcgaccgctacgagccgctgccgccctcactgccggccgcgggcgagcaggactgctgcggggagcgcgtggtcatcaacatctccgggctgcgcttcgagacgcagctgaagaccctttgccagttccccgagacgctgctgggcgaccccaagcggcgcatgaggtacttcgacccgctccgcaacgagtacttcttcgaccgcaaccggcccagcttcgacgccatcctctactactatcagtccgggggccgcatccgccggccggtcaacgtgcccatcgacattttctccgaggagatccgcttctaccagctgggcgaggaggccatggagaagttccgcgaggacgagggcttcctgcgggaggaggagcggcccttgccccgccgcgacttccagcgccaggtgtggctgctcttcgagtaccccgagagctccgggccggcccggggcatcgccatcgtgtccgtgctggtcatcctcatctccattgtcatcttctgcctggagacgctgccggagttccgcgacgagaaggactaccccgcctcgacgtcgcaggactcattcgaagcagccggcaacagcacgtcggggtcccgcgcaggagcctccagcttctccgatcccttcttcgtggtggagacgctgtgcatcatctggttctccttcgaactgctggtgcggttcttcgcttgtcctagcaaagccaccttctcgcgaaacatcatgaacctgatcgacattgtggccatcattccttattttatcactctgggtaccgagctggccgaacgacagggcaatggacagcaggccatgtctctggccatcctgagggtcatccgcctggtaagggtcttccgcatcttcaagctgtcgcgccactccaaggggctgcagatcctcgggcaaacgctgaaggcgtccatgcgggagctgggattgctcatcttcttcctctttattggggtcatccttttctccagcgcggtctactttgccgaggcagacgaccccacttcaggtttcagcagcatcccggatgccttctggtgggcagtggtaaccatgacaacagtgggttacggcgatatgcacccagtgaccatagggggcaagattgtgggatctctctgtgccatcgccggtgtcttgaccatcgcattgccagttcccgtgattgtttccaacttcaattacttctaccaccgggagacagaaggggaagagcaatcccagtacatgcacgtgggaagttgccagcacctctcctcttcagccgaggagctccgaaaagcaaggagtaactcgactctgagtaagtcggagtatatggtgatcgaagaggggggtatgaaccatagcgctttcccccagacccctttcaaaacgggcaattccactgccacctgcaccacgaacaataatcccaactcttgtgtcaacatcaaaaagatattcaccgatgtttaatatgtgatacaagtgacatgctgtgctcagtattgtgtggaacgtgcccccttggtctgcctatgcccttgttttatacatttccagaccattcatcaaggaaaggacctgaagaagtggaaagcacacttcattctccctctccctgctgcttcatactgaaacaggtgcctgttttgcaagtgggctgcattctctcagctctccttttccctcttaccctctctctcttaacattgtaaacaacagacttacgttaaacttcatttctagtacacgccctatttaaaaaagagcagtacatcctgggaggaaatgaaactaaagaacagttagagtaactgtttaacctcagaattttaaaggcagttgtttctttcctaagcacatcaattcgtagtaaatgatgcttcggtttgatggacctttcaacgttatttattgaatatgtatttcggttgcctaccctgtagatatgtggatgaagagtctaactagaataatgacttgtaaacccaccatgagttatttggtttttgacttaaattcctatttgaatcccctttcccggaattttaagtgtctctacaactttgaataaagggaaatgcccaagatgtcctgatctgactaattagtttaattctttcgggcttgctaagcatttctaaagcattagactaacagattcctgtgaagttctgtgcatatgtcccagccccaacaactatcaaagtctagaaacagatgttttcagtgttgctgagagaaacaaaaaatttcctaatgcatctgagagataagcttcggcagtatcacaagaagattaaagtggcagacaccccttccagcggaagttactaattcggacctgactgatgcagtttccatagcaacccatgtttcctgggaaacccgaaaaaggttgtcatggcatctcttgctctctagccccacctcccagcccctgccgtttccacagtaacctttccagatggttcctacttaaatgatttcataaggaaaaccactgtttgaataagccgcacaaaaaataaagttaagtctgagactctaaggaggtgaaatgaatcccaaatgcattttttaactatgaaaatcattatgtcattccataatgactgaatcaaggaggaaaatatggtgtttggaatgttagatattaaccacaataaggcatgatctggattaaatgccatttattaggcaataatttttaaagatgcttctctacagttttctttctccaagaactttcaagccaacaaatgaaatttaaaagcaaatgtaaaagtgttctgtacataagcaaatgagagattcgatcagtgtgcctgaaaccttactacaagggaccttcaggctttctcttt

SEQ ID NO: 23327 - DNA, 4172 bp, Homo sapiens
gttcgcggccaggggaggcgtgtgctgctcccgcagccagcgagagcgagagagggatggatgttggaggaggaattcgggcttaacaagtgatcgctgctgtctaggattttgtttcttttcgggggaaccttgacttcctttcccaggcaatccctcctgtgctgaactccagaggaaccaggagtcttggggtcttctctggggcagccccaacccccacccccaggctccagccgcgaggactctgtgcacccctcgggccaggcaacagaacttgttccgtggatatttggagcctccacctgccaaacccgagtgattccttttaccaccccccgccccccacccaggatcattcttcccctcctccagctgttgcagcttgagggggaaaaacaagccagccggtggattttctttatttttatttttcgccccgccggggaacggtgaagtgcttcttctgcatgattttggctgaagaatgctctgcatttccttgatttctatggagacctcagagctggttttgcttctgctgacacctcatctagcaccttctctacctcccagggtctttgcctctatctgtggtttggcattgtacctgggtacaggaagcctttgatgaacttaaaaggagagcctggagaatcatcctgatagactttgagtagaaatggctggacatacttcaaaccacatcttaacatggttcgagccatcactagaaggcaagtgctaacagtaaaggcttatttgcattttatttacatttaatggactgagcattggccaatttccatggcagaaaaatatatttcattttctaggcacaacttctggctgtcagacacttgctgcctttgaatcttgcagcaacatcactaaccacatcccagacatatttccaaatttcaacatctacccccaaaacataggtgtctgagagactccagcattttcggacttcttagtcttgagagtgccaggctatttatctcgaccagccaagctctggagagcaatgttgaatccctgagaagagagagcatggggcgtgctgatttaaaaacagaaaatgcaaagttggactgaaaatatccttagtcttccaagcaatctgcttaagggttccaaacttaccttaatttggtgagaaaagaagctgccctatttttctttcttcttcttctacaactggaaccagccatttccgaaaaccaccaccatggaggttgcaatggtgagtgcggagagctcagggtgcaacagtcacatgccttatggttatgctgcccaggcccgggcccgggagcgggagaggcttgctcactccagggcagctgcagcagctgctgttgcagcggccacagctgctgtcgaaggtagcgggggttctggtgggggctcccaccaccaccaccagtcacgcggggcctgtacctcccatgaccctcagagcagccggggtagtcggaggaggaggcgacagcggtctgagaagaagaaagcccactaccggcagagcagcttccctcattgctctgacctgatgcccagtggctctgaggagaagatcctgagggagctgagtgaggaggaggaagatgaggaggaggaggaagaggaggaagaggagggaaggttttactatagtgaagatgaccatggtgatgagtgttcctacacggatctgctgcctcaggatgagggcggtggcggctacagttcagtccgctacagtgactgttgtgaacgtgtggtgataaatgtgtcaggcctacgctttgagacccaaatgaaaactctggcccagtttccagagactttgttgggagaccctgaaaagaggactcagtactttgaccctttgcgcaatgagtatttttttgacaggaaccgccccagctttgatgccatcttgtattattatcaatcaggaggccgcctgaagaggccagtcaatgtcccctttgatatcttcactgaggaggtgaagttctatcagttgggggaggaggccctgttgaagtttcgggaggacgagggctttgtgagagaagaggaagacagggccctccccgagaatgaatttaaaaagcagatttggctcctctttgaatatccagagagctccagtcctgcaaggggcatagccattgtgtccgtcctggtcatcttaatctccattgtcatcttttgcctggaaaccttgcctgagtttagggacgacagggatctcgtcatggcactgagtgctggcgggcatggtgggttgttgaatgatacttcagcaccccatctggagaactcagggcacacaatattcaatgaccccttcttcatcgtggaaacagtctgtattgtatggttttcctttgagtttgtggttcgctgctttgcttgtcccagccaagcactcttcttcaaaaacatcatgaacatcattgacattgtctccattttgccttacttcatcacactgggcactgacctggcccagcaacaggggggtggcaatggtcagcagcagcaggccatgtcctttgccatcctcagaatcattcgtctggtccgagtattccggatcttcaaactctccaggcactccaaaggcctgcagatcctgggccacaccctcagagccagcatgcgggaactgggccttctgatcttcttcctcttcattggggtcatcctcttttctagtgctgtgtattttgcagaggcggatgaacctactacccatttccaaagcatcccagatgcattttggtgggctgtggtgaccatgacaactgtgggctatggggacatgaagcccatcactgtagggggcaagattgtcgggtccctgtgtgccattgcgggtgtcttaaccattgctttgccagtgccagtgattgtctctaactttaactatttctaccacagagagactgaaaatgaggaacagacacagctaacgcagaatgcagtcagttgtccatacctcccctctaatttgctcaagaaatttcggagctctacttcttcttccctgggggacaagtcagagtatctagagatggaagaaggagttaaggaatctctgtgtgcaaaggaggagaagtgtcagggaaagggggatgacagtgagacagataaaaacaactgttctaatgcaaaggctgtggagactgatgtgtgaatctttttccacctgccactgctcccccctcagcatctccaaatatatttatgcatagagagtgcagttatgaaaatgaaatatgcaaatgatccaatgcatacagtagtacactatttaatggttatacatggcataattgttactaaacttgtattacatatcaaataaatgatacatcttggagaagagggaggaataggagcaaatctatctttatatttttattagaatgcaagaattttgcacattaactggaaaagatgttaacagtaaagatggagagagagagtgtgtgcgtgtgtgtgtatatgtgtgtgtgtgtgaagtaaattgtcaatgttagtaattgtgcagtgaagggaaaagttggcattttgaagtatttactatgtaagaactaatgaatctgagcagtcatttatcagtgctttaacagcatatcgtatgtctttggattctgtagttgttttttaaaaattgtaagaaatactgtgtagagaaaaaagaaagtaaattatttaatagactataggtcacaattttatcttggatttaattaaaatttatttttaactggaaattaacttttaaaaaggctgcaagggcctttagaaattgattatattttgttattaattttgggaagacttaacagcaaatgtctaacattatagaataagtgaaattggagaatatgtaataagttttgtttgcaggtaacaggactggatttttttttctttgcactactttatatgctggagattgagagagacttcaaactgtgaatgtttactaatgtaacagttcaatgacaatcattggaagaatgatttctttagtcttattttattgttttcttttcattgtgtgagactaatgatcatgcagataacatcacaggattctctcctcttttaaaatctaaataactgattgacaaaggaattatgaagtaaaatttagcaactga

SEQ ID NO: 23328 - DNA, 2865 bp, Homo sapiens
ttttcggctgcttggtaacgggctgccagaagagagagaggcagagagcagggcagcggcttcttgacgtcagggccaagcgaggggatcgcgccagcaaccccagctctccccagagaggggccggccgaccgctggagcggagcctgacgccaggcgcccgcggagcgtgagtagggggcgcgggagccggtcagctggggcgcagcatgccctctgctcccgcgccatggagatcgccctggtgcccctggagaacggcggtgccatgaccgtcagaggaggcgatgaggcccgggcaggctgcggccaggccacagggggagagctccagtgtcccccgacggctgggctcagcgatgggcccaaggagccggcgccaaaggggcgcggcgcgcagagagacgcggactcgggagtgcggcccttgcctccgctgccggacccgggagtgcggcccttgcctccgctgccagaggagctgccacggcctcgacggccgcctcccgaggacgaggaggaagaaggcgatcccggcctgggcacggtggaggaccaggctctgggcacggcgtccctgcaccaccagcgcgtccacatcaacatctccgggctgcgctttgagacgcagctgggcaccctggcgcagttccccaacacactcctgggggaccccgccaagcgcctgcgctacttcgaccccctgaggaacgagtacttcttcgaccgcaaccggcccagcttcgacggtatcctctactactaccagtccgggggccgcctgcggaggccggtcaacgtctccctggacgtgttcgcggacgagatacgcttctaccagctgggggacgaggccatggagcgcttccgcgaggatgagggcttcattaaagaagaggagaagcccctgccccgcaacgagttccagcgccaggtgtggcttatcttcgagtatccggagagctctgggtccgcgcgggccatcgccatcgtctcggtcttggttatcctcatctccatcatcaccttctgcttggagaccctgcctgagttcagggatgaacgtgagctgctccgccaccctccggcgccccaccagcctcccgcgcccgcccctggggccaacggcagcggggtcatggccccgccctctggccctacggtggcaccgctcctgcccaggaccctggccgaccccttcttcatcgtggagaccacgtgcgtcatctggttcaccttcgagctgctcgtgcgcttcttcgcctgccccagcaaggcagggttctcccggaacatcatgaacatcatcgatgtggtggccatcttcccctacttcatcaccctgggcaccgaactggcagagcagcagccagggggtggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacaaccagggaacccatttctctagcatccctgacgccttctggtgggcagtggtcaccatgaccactgtgggctacggggacatgaggcccatcactgttgggggcaagatcgtgggctcgctgtgtgccatcgccggggtcctcaccattgccctgcctgtgcccgtcatcgtctccaacttcaactacttctaccaccgggaaacggatcacgaggagccggcagtccttaaggaagagcagggcactcagagccaggggccggggctggacagaggagtccagcggaaggtcagcgggagcaggggatccttctgcaaggctggggggaccctggagaatgcagacagtgcccgaaggggcagctgccccctagagaagtgtaacgtcaaggccaagagcaacgtggacttgcggaggtccctttatgccctctgcctggacaccagccgggaaacagatttgtgaaaggagattcaggcagactggtggcagtggagtagggaatgggaggcttgctgaacatggatatctacattataccgcagagtatttgaagtcacactgtaacctcagtctacccctctcctttcactcctttcctccctccctcgatccccccattttctctattctttccatgacacccaagggtcgcctatttttaaaaagtaccacattccatgacgcaggagctgtggaaatggtgagcgctgtgagatggatgtatttgtagccagtctcctatacccagcagagggataacccaaacaaaaatgactctaaatagcccagatcccaagagattatgtaactcctccatccatgtgttccaaatttgctttacatatgattgtatttgtgtataggggaaaatattatttttatgcctggtaagtggctttttgtactgtagttcagatagagatattttgggtatattttcaagatacatgttgtatttatggaagaaagagttgtcctgatgtttttctgtgttacttatattagagtcagagatcttggtatgggctgttctgtttcctgtgtctccaagcctctgtcttttctgggatgtggtattggtgctttgtgtctagggcagagtatgttcttgaagaaaggcaaatctgactttttctgtgcgccttaaacaattcttgtaactttcttcaaaaagcattttaatgatattggaggaatacttctgataatttattgtctttatttttatcccaggaaataaaaggttaccttgttga

SEQ ID NO: 23329 - DNA, 4372 bp, Homo sapiens
aaacttggagagacgcaggacaggatcccggcggcagaaggacggagagaaaggggaccccgggacgggaaaggcgcagagcaggcgcgggcggcggcggcggcggggcagggcagggcgggcgtcccggcagagggcgcgcggtcgccctgtcgccctccgccccgccggggtcacagtgccccctccctcgcgccctagccgccctgccgggctatttttacgcgcggacaccggacaccggacaccgggctggggcggcggcggcggcggccgaggcggccgaggcggggccgcaccggggccgggcgtcggggccacacgtcggttcgcgggtcgccggggctgcgcgcgccatggagccgcggtgcccgccgccgtgcggctgctgcgagcggctggtgctcaacgtggccgggctgcgcttcgagacgcgggcgcgcacgctgggccgcttcccggacactctgctaggggacccagcgcgccgcggccgcttctacgacgacgcgcgccgcgagtatttcttcgaccggcaccggcccagcttcgacgccgtgctctactactaccagtccggtgggcggctgcggcggccggcgcacgtgccgctcgacgtcttcctggaagaggtggccttctacgggctgggcgcggcggccctggcacgcctgcgcgaggacgagggctgcccggtgccgcccgagcgccccctgccccgccgcgccttcgcccgccagctgtggctgcttttcgagtttcccgagagctctcaggccgcgcgcgtgctcgccgtagtctccgtgctggtcatcctcgtctccatcgtcgtcttctgcctcgagacgctgcctgacttccgcgacgaccgcgacggcacggggcttgctgctgcagccgcagccggcccgttccccgctccgctgaatggctccagccaaatgcctggaaatccaccccgcctgcccttcaatgacccgttcttcgtggtggagacgctgtgtatttgttggttctcctttgagctgctggtacgcctcctggtctgtccaagcaaggctatcttcttcaagaacgtgatgaacctcatcgattttgtggctatccttccctactttgtggcactgggcaccgagctggcccggcagcgaggggtgggccagcaggccatgtcactggccatcctgagagtcatccgattggtgcgtgtcttccgcatcttcaagctgtcccggcactcaaagggcctgcaaatcttgggccagacgcttcgggcctccatgcgtgagctgggcctcctcatctttttcctcttcatcggtgtggtcctcttttccagcgccgtctactttgccgaagttgaccgggtggactcccatttcactagcatccctgagtccttctggtgggcggtagtcaccatgactacagttggctatggagacatggcacccgtcactgtgggtggcaagatagtgggctctctgtgtgccattgcgggcgtgctgactatttccctgccagtgcccgtcattgtctccaatttcagctacttttatcaccgggagacagagggcgaagaggctgggatgttcagccatgtggacatgcagccttgtggcccactggagggcaaggccaatggggggctggtggacggggaggtacctgagctaccacctccactctgggcacccccagggaaacacctggtcaccgaagtgtgaggaacagttgaggtctgcaggacctcacacctccctagagggagggagggagggcagggtggagggcaaggctggggggaggggattgggtttaggaagagctaggttaagtcgtaacgagtggggaaacactgagtcttgttgggtcttgggttgtgtggtttggtagctcctgtgggtacctcctgaagcagcagcgaatggcaatgggttgtgttgtgttaatgaagactcaattggttcatattactctgagttgtgcaaagctcatggagccttttggggtagtgttgagataggtttggtcgtatcattttgtgagtttcctaggtcagtgttgggtttggttgggttgtgagtctgggatagtgtggtccagctgcattgtgtaggattctgtggtttggtgggtcccctagggccatgttgggtcaagttagatggtcccccatggcattgttgagatcgaatgtgtgtggtgttaagtttcgttgagacatggtggaaattgtgtagctctgtgattcttccaggggcatgttattttaggttctgtgaacttgcgagtcatgtagaaatgtgaagagtccagtggtagaatttgagctttctaggtcacattgggttaagtttgtatgaccaaatgaatcttgtagggttctgttgggcttaactgtgtagaggtgtgtggctggacatttttcgtggccacagcgagttgagttgtgttgaattgtacaaccatatgagccttgtaaggccagttcagttgggtcatgccactgtttgagtctcatagggccatgctgaattgagttccattgagttgtgtcactatgtgagtcctacaggaagttgggttgagttggactgtgcgaacgagttccatagggccacatcgggctgttttgcatttagtggtagcaccaggacccaaaggaaatagcagtggggaagcatcatgtatctgggagcatgcagtggcgagggctctgggaggtgtgccgagctggctccccagctcgctgtagggggcgggactggattctgtatccatgggattgggtgttcatccagaggcgactgggtaaattaggaagaggtggatgctcctcctgtttaccccacatccacttcattgtgctgttcactcccattctcccctacagttttatgctcagacatggaggtcagagccacaagggaaaggggagagggggagaaaactgtactctgtccagacatgatagagggacagagccaaaaggatagagaaagagacccagaaaaaggaagaggtggaaacccagagagacagagacccaaagggagagaaacagagactcagggagagggagacaatgacctggagggtggggtatggcagagacgcagaagagaggaacagaaatccagagtggggagacagagaccaagagcaggggatagaagccgggcgaagtggcccatgcctgtaatctcagcactctgggagaccgaggaagggggattgattgaggccaggagttcaagaccagcctgggcaacatggtgagaccccatctctacaaaaaatacaaaaattagctgagtgtggtggcacatgcctgtgatcccagctactcaggaagctgaggcagaaagatcccttgaccctgagaggtagaggctgcattgagccatgattgcaccactgcactccagcctgggcaacagagggagcccccgtctcaacaaacaaacaaaaagagccagtgggggagggagggacagagacccagagggcagcgtcagacacccagagttggagacagaacaacagagtctcagggaaagagaaccacaatagaaaaaggcagaaaaggccgggcgcggtggctcatgcctgtaaccccagcactttgggaggccgaggtgggcaaattacgaggtcaggagatccagaccatcctggctaacacggtgaaaccccgtctctactaaaaatacaaaaaaattagccgggtgcggtggcgggcacctgtagtcccagctactcgggaggctgaggcaggagaatggcatgaacctgggaggcggagcttgcagtgagccgagattgcgccactgcactccagcctgggcagcagagcaacactctgtctcaaaaaaaaaaagaaaagaaaagaaaaagccagaaaaagttggtgcccctgaacccaagagtgatgtacagtctattccatagaatcacagaacaatcctgaaccaggcctgtcacctaccctccctgcagctcaggaaggctgtcagacaggctgggggcctcactctgttttccaggggagaaacctgagtctcagagcaggggagtggcttcccaaggtctcacagcttgtccccaggggccaggcaggctgtctgtctgcttcacatgtccccatcagcctgctgggacacacgggtcctcctgagtcccgtagcctcatttcttacagacggggaaactgaggctcagagcagcaggtgttacccaaggtcacaaggccgaacattttcagaaatctttcagaactcaaagggcatttagaggaagaaggctgaaatcactaacacatatagggcttcctttggtatcaaagtactttacttgggttaatttatta

SEQ ID NO: 23330 - DNA, 5331 bp, Homo sapiens
cggctgctcgcgagctgctttctctcctcttccctttccgggtgcacggcgaggagaaagtctctatgcaactaagccccggcgcgcacttggccaggtatgtaccgcgggagcggcgcgttctgcgcggaagcagatgctgctgccgccacggcggcggcggctgccagctcctgagctctgtaactgtcacactgcacctgagctgaacttgaaaagagagtgaaggggcgattgggcgaacgcttttggcagacacagagggtgtttgtagacgtgggggaggagaatctctattaacgccccccaccgtaaccactgcacatcacctccatctctgcaaatacagcccgaggagtagaggcagcagcagctggacccccaaagagagacgtggggcagcggctgtgaccgcatctcctgagctacaacaacaggtcgcctttttgagactcctttggcgggaagggctacttggaaaggaaggtttgaaagagtgagaagggtaggtgtaagggttccctaattcgtcgaaagaattctattgggtgactctcgttcgtcttctctatcctacactccacatactgaccctatattatccagactgtgccggggagaaatcaaaaacacctgtttgaagaaacggctgcacctgtgtgcttatttgtgccagagggtggcctagcccacctgcaggaagagatttggctgggttctgttgagggtgattgttaggacgttgtattttgttgccattattccaaatacctgtcttggagggaaagttgcccttctgagaactgtgactttaccaggagccctatcttggaataagagttacacctctggaccacgtttctcactagtactttgcttgactggaggaagtgggtgacttttggctgcttcggtgacccattgtagacgcctcgttacccttcttccttccgcttcaagtaatcatggcggcgggggtggcagcgtggctgccttttgcaagggcagcggctatcgggtggatgcctgtggcctcggggcctatgccggctcccccgaggcaggagaggaaaaggacccaagatgctctcattgtgctgaatgtgagtggcacccgcttccagacgtggcaggacaccctggaacgttacccagacactctactgggcagttctgagagggactttttctaccacccagaaactcagcagtatttctttgaccgtgacccagacatcttccgccacatcctgaatttctaccgcactgggaagctccactatcctcgccacgagtgcatctctgcttacgatgaagaactggccttctttggcctcatcccggaaatcatcggcgactgctgttatgaggagtacaaggatcgcaggcgagagaacgccgagcgcctgcaggacgacgcggataccgacaccgctggggagagcgccttgcccaccatgactgcaaggcagagggtctggagggccttcgagaacccccacaccagcacgatggccctggtgttctactatgtcacggggtttttcattgccgtctctgtcatcgcgaatgtggtggaaacagtgccgtgcggatcaagcccaggtcacattaaagaactgccctgtggagagcggtatgctgtggccttcttctgcttggacacggcctgcgtcatgatcttcacagttgagtatttgcttcgcctggctgcagcgcctagtcgttaccgttttgtgcgtagtgtcatgagtatcatcgacgtggtggccatcctgccttattacattgggctggtgatgacagacaatgaggacgtcagcggagcctttgtcacactccgagtcttccgggtcttcaggatctttaagttttcccgccactctcaaggcctgcgcatcctggggtacacactgaagagttgtgcctcagaattgggcttcttgcttttctcgctcaccatggctatcatcatcttcgctacagttatgttctacgcagagaaggggtcttcggctagcaagttcaccagcatccctgcagccttctggtataccatcgtcaccatgacaacactagggtatggtgacatggtgccaaaaaccatagcagggaagatttttggttctatctgttcgctgagtggggtcttggtcattgctctacctgttccggtgattgtatccaacttcagtcgcatctaccaccagaatcaacgagcagacaaacgaagggcacaaaagaaagctagactggccaggatccgggcagccaaaagcggaagcgcaaatgcttacatgcagagcaaacggaatggtttactcagtaatcagctgcagtcctcagaggatgagcaggcttttgttagcaaatccggctccagctttgaaacccagcaccaccacctgcttcactgcctggaaaaaaccacgaatcacgagtttgtggacgaacaagtctttgaagaaagctgcatggaagttgcaactgttaatcgtccttcaagtcacagtccttcactgtcttcacaacaaggagtcaccagcacctgctgttcacgacgacacaaaaaaacttttcgcatcccaaatgccaatgtatcaggaagccatcaaggtagtatacaagaactcagcacgattcagatcagatgtgtggagagaacacctctgtctaacagccgatccagtttaaatgccaaaatggaagagtgtgttaaactaaactgtgaacaaccttatgtgactacagcaataataagcatcccaacacctccagtaaccacaccagaaggagacgataggccagaatcccctgagtactcaggaggaaatattgtcagagtttctgctttgtaagacaattggaataaggtctaagagaattcgagccctggctgtgaaaagaatctcaacatagaagaaagaagaaacaataaatattctgcagattaatgcagcaaagaaagaaggttggtagtgaaacacaaagcttccaatcttaaggatgtgaataaaaccaccaaatggcatttctagacagtttgacctgttatacagagtaatattctgtggccctttgactttgtgaatgagcacaatgaaatgccgcctactgatgcttcttatgatcagaactcttttttaataaaataaataacataaatcgttgaacataatgttccagttgaatgcaaaacaaaaaaaatatggaaaacattttgataaaattttttcctgttaaaaccatgaacattggctatgatgaagattattacatatgaaaaaaaaactcacacaacatatttgtattgactgaaggaaaccatcataatgcatgctagaattctttgaagcagtgatctcagtttccttatgttgtcttcagaataggcatgataaactataattgtagaaaggggtaatttctgtgcacttacaacaagctgagtgttcatgttccatggtgggctgtgcaaataaactccttttagacctgcagtatttctcatggggatgctcattagtaaatctaaagtgttcagatagttcagtattcattatcgtttaactttgcacctagatactgttacaactgcaataatttgttgtacaactgttgtatcaggaatcaggatttttttgttgttgtactttccagatccttatagatacggtaagagccacattcgtagaaaaacttctggtgtggccaggttttaggtaactttttaatccaaaactattgtgccataaatgtttttcagtaatattttttggtccactgtattcctgtgacacagtgcattatctgttcttgtatttctatagcacctctctattgggtttatcatcatcaacaagactactgtttactgtagttcaagtgactttcctacttttgtatttccaaaaaaaattatcttgtaagtagcttgtcatcaatccccttgtcgaaaactagaaaaaaaggagttgacccatataaattatctctaacgtctttgttgtttatggaaaagcccagatactggatatatcactatgtattttatgaacagaattgactgggactaatatcacaggatcaatcatctcagaatcttacttgatgcattatttattttgctttagatcttgaatacattttgagaataactaatgtggattgaaatgtagagatacactggagtgctttatttagcaatatttgatgaaagcatgctttctacgccattcaggaaggcagcacaaatttatctcagaaaggttcctgtgtattgcaaggtacaattttctccaataaatcaggagaacaggagtttgatgatgcaaagttgatctctgtacatttaagtgaaaagtctttataacttttcacccttaaaatatttcagcagacatgtctgcacatgacagtgtaaaaaagtttaatgtcaaatgcaaagtttttattcattccaagccaccactgtaaggaataaagcttagcttctgtacatggaaagagctaataattatccctctgtcagagatgagatttttaaatgcttatgatatttaatcataaaaagggattaatccaaccattttctagtaaagccagaaattcttgcttcccatttctagaatagtttctagaacagtgctatgcacatattagatcttaataaacatttgctgagtgaaagtaagataaactcaactatctcttgggaagaactggcttcattcctagtacatcttttaaaaagttactaattttccagcagtacaaatattaacaattatattaacacctgcctcatgtcagtttatgcttctagagcaatgtctagtgaaacttatctgatggcatttattgaaaaccttctaaaaagtagactaaggaaaccataatcagaattactatgtcttttgattcccaatgagaagttctattttcatgttcttaatattacatacaagaaaatgcagttaggttatttcaattgacaattctgcctcctcttttgatttatcacttacccaaaattattaattttattaggcttttggaaaagaaaaaaaactttttgatgttttaggtgatttaaaaatataccgtgttggtggtgaatgactattgatgactgtgttaagtgcatctgtattgtaagtgaaatgtaattatttctgtgtaccatatggagtaactaaggtcattgtttttgacaattttgtttgaaattcatatatcttatttcaaaggatagcataatatctgcattatgctggaaaaaaatagacctttggagaatacttaaataaaacatgtgcatgcttgaacagg

SEQ ID NO: 23331 - DNA, 2659 bp, Homo sapiens
ggagagaaatggctgaaagtggaaacccggagcggtttggggcgcttcgcaaagttctccagctcggcgagccggcggtgtgtctaccagaggctgggggccagtccatctggtcctgcccgacgccacttccaccccgcgagctctgggaaaggtctctacgtgacgccaagggccgtcgcggccccggggagagggatcgaaagactcactctgcgaggtgtttacactggaggtgggggacgggaagggactgggcaaagttacctggactcaactaaattcctgcgcttgcttagtgttgacatttgaataggatccgagatgttctgcttttatcccgggcagccctgatatgtcagcaacaggctgaggttccagacctgaaatcgcactgcaagaaaaaggggtttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactgggatacggagacatggtgcctaagacgattgcagggaagatcttcggctccatctgctccttgagtggcgtcctggtcattgccctgccagtccctgtgattgtttccaactttagccggatttaccaccagaatcagagagctgataaacgcagggcacaaaagaaggcccgccttgccaggatccgtgtggccaaaacaggcagttcgaatgcatacctgcacagcaagcgcaacgggctcctcaacgaggcgctggagctgacgggcaccccagaagaggagcacatgggcaagaccacctcactcatcgagagccagcatcatcacctgctgcactgcctggaaaaaaccactaaccacgagtttattgatgagcagatgtttgagcagaactgcatggagagttcaatgcagaactacccatccacaagaagtccctcactgtccagccacccaggcctcactaccacctgctgctcccgtcgtagtaagaagaccacacacctgcccaattctaacctgccagctactcgcctgcgcagcatgcaagagctcagcacgatccacatccagggcagtgagcagccctccctcacaaccagtcgctccagccttaatttgaaagcagacgacggactgagaccaaactgcaaaacatcccagatcaccacagccatcatcagcatccccactcccccagcgctaaccccagagggggaaagtcggccaccccctgccagcccaggccccaacacgaacattccttccatagccagcaatgttgtcaaggtctccgccttgtaaaaccactggacagagggccagagtgggtagtggggaatgaaggggactggcatgttggtgggtggtcactgagaccactccctcccccctttccccactatttctgcctgccccattgtacccctagcactgagacttgtgcctggaaggaaaaagaggtagcaaaggggcacctgaggttcacgctgctagcgtggacatagccctgtgatactgcatctcactggggccagaggaagggagggagggtgggggggtcggggatagg

SEQ ID NO: 23332 - DNA, 2716 bp, Homo sapiens
ggagagaaatggctgaaagtggaaacccggagcggtttggggcgcttcgcaaagttctccagctcggcgagccggcggtgtgtctaccagaggctgggggccagtccatctggtcctgcccgacgccacttccaccccgcgagctctgggaaaggtctctacgtgacgccaagggccgtcgcggccccggggagagggatcgaaagactcactctgcgaggtgtttacactggaggtgggggacgggaagggactgggcaaagttacctggactcaactaaattcctgcgcttgcttagtgttgacatttgaataggatccgagatgttctgcttttatcccgggcagccctgatatgtcagcaacaggctgaggttccagacctgaaatcgcactgcaagaaaaaggggtttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactgggatacggagacatggtgcctaagacgattgcagggaagatcttcggctccatctgctccttgagtggcgtcctggtcattgccctgccagtccctgtgattgtttccaactttagccggatttaccaccagaatcagagagctgataaacgcagggcacaaaagaaggcccgccttgccaggatccgtgtggccaaaacaggcagttcgaatgcatacctgcacagcaagcgcaacgggctcctcaacgaggcgctggagctgacgggcaccccagaagaggagcacatgggcaagaccacctcactcatcgagagccagcatcatcacctgctgcactgcctggaaaaaaccactgggttgtcctatcttgtggatgatcccctgttatctgtacgaacctccaccatcaagaaccacgagtttattgatgagcagatgtttgagcagaactgcatggagagttcaatgcagaactacccatccacaagaagtccctcactgtccagccacccaggcctcactaccacctgctgctcccgtcgtagtaagaagaccacacacctgcccaattctaacctgccagctactcgcctgcgcagcatgcaagagctcagcacgatccacatccagggcagtgagcagccctccctcacaaccagtcgctccagccttaatttgaaagcagacgacggactgagaccaaactgcaaaacatcccagatcaccacagccatcatcagcatccccactcccccagcgctaaccccagagggggaaagtcggccaccccctgccagcccaggccccaacacgaacattccttccatagccagcaatgttgtcaaggtctccgccttgtaaaaccactggacagagggccagagtgggtagtggggaatgaaggggactggcatgttggtgggtggtcactgagaccactccctcccccctttccccactatttctgcctgccccattgtacccctagcactgagacttgtgcctggaaggaaaaagaggtagcaaaggggcacctgaggttcacgctgctagcgtggacatagccctgtgatactgcatctcactggggccagaggaagggagggagggtgggggggtcggggatagg

SEQ ID NO: 23333 - DNA, 7396 bp, Homo sapiens
tttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactgggatacggagacatggtgcctaagacgattgcagggaagatcttcggctccatctgctccttgagtggcgtcctggtcattgccctgccagtccctgtgattgtttccaactttagccggatttaccaccagaatcagagagctgataaacgcagggcacaaaagaaggcccgccttgccaggatccgtgtggccaaaacaggcagttcgaatgcatacctgcacagcaagcgcaacgggctcctcaacgaggcgctggagctgacgggcaccccagaagaggagcacatgggcaagaccacctcactcatcgagagccagcatcatcacctgctgcactgcctggaaaaaaccactaaccacgagtttattgatgagcagatgtttgagcagaactgcatggagagttcaatgcagaactacccatccacaagaagtccctcactgtccagccacccaggcctcactaccacctgctgctcccgtcgtagtaagaagaccacacacctgcccaattctaacctgccagctactcgcctgcgcagcatgcaagagctcagcacgatccacatccagggcagtgagcagccctccctcacaaccagtcgctccagccttaatttgaaagcagacgacggactgagaccaaactgcaaaacatcccagatcaccacagccatcatcagcatccccactcccccagcgctaaccccagagggggaaagtcggccaccccctgccagcccaggccccaacacgaacattccttccatagccagcaatgttgtcaaggtctccgccttgtaaaaccactggacagagggccagagtgggtagtggggaatgaaggggactggcatgttggtgggtggtcactgagaccactccctcccccctttccccactatttctgcctgccccattgtacccctagcactgagacttgtgcctggaaggaaaaagaggtagcaaaggggcacctgaggttcacgctgctagcgtggacatagccctgtgatactgcatctcactggggccagaggaagggagggagggtgggggggtcggggataggccgggggatataggctatgtgccaggacagggcctggatggaggagcctcagactcagaccaaataacagtcgtttctggagaccccagtgaggaaaatacaagaccaagagcagcaaagaggccaagttgtcacaagcaaaacaggaagaaaatataacactgtgtatttaagcacctttttcaaggctcttaatggataatatttattcatgggaaaaggtggaaaacaaaaacaccaacggatttttgtgaaatgtttttctccatggacccaacacctttgaaccaaaacaatgcattttgtgagggatttttttttctccttttatagcaaaagcttttaggctaagaagtcagttattgctgagttctctctccattcccccaggtgggtgaggtcaactgagcctgggcccccactgcccagctgacctgtgcagagctgccaagtgaccacacggcaatccttaccctttgtctgtccctgtctcccttgtctctgtacctctctgcttacccctagctgtttctgtgtccagccatctgtctctacctggatcccaatgatcctgaaacacatcagtaaagccttcttcatcactgccacgcacaacagacttgtgcctgggagttctatctgtgtgaatgcaactgcagaggaggaaagagtgaagcaaaaattgggagagtttaggggtaagggaagtctacctcacagaacagaggtacttcccttggggttggaaccactcgtgtttgcagtttcagtttctgggaaagaaagggaatgaacagatttatcacactggaatcttgaaaaggcaaatcgccaacacctgagacgcggtcaactctggtatgtgccagtgaggggagaacggaaggacccagggctcgcagcctcagccggtcattagggcaccttgctatggacccttccttcaagacccaccataaagcccatccagagcccttccaagaggccccgggagtagttttctccagagagggcagtggtacggggaccaagattcctctgacttatatcaaaccagaggcaactcccacacagaggctgtggaagggtaagcctgtgtgcctcaagaaaaatgcttcaaagcaaaagcaagtaagagattctagatgattcttacctgctatgaaagatgccttgatgtctgaagaggcttcggcctgatctccctgaagatgctgaaatgggggagaagcctcatcacctctgtgcaagcaaaggagtgaagattatttcttgaacacctggacaacatatctattcaactagcttgcaccctggtggagctgggggcagcatttctggaatcctcctaaccattgttcactgcttgtagcagagtaggtgggcctcagggttagtgacaagtcctttcctgcccttcccaacacccagccaccttgctgcagtctctgtagcctgggctctgaaatacatgagctcctcgggagctgcctatccatcctacagcttagtggttagctgtttaattgtaggccaagaatttctctccccaccacagccatctaaatgagttttactagccaggaacctaaaaacacccttcgtgggcttccctatgaccccagctcgattgaccctgtaggttcaaaaggtttcgaggtggcacctaaccagaatgtgggcagaaggcagaggagagggagccttctttctgtctttatctctttatgcttatcctcattgaccatgggctgagttctttctctgggtcccctaatgtgggaatggagtggttcttgccctctgagcttacagactaagaaggcagaaaagctttacaactacagagtacatgtgtatacacacaaccaacctaaacacatcagagaatacatacttaaatcaattcacttcatatacacatctcattagaagaccaagctaaacttcacttagagggcgggcaaaggactagaaaagaatttttctcttaaaaaaaatgagtactagagcaaaattatgagtgtctaagtatcttagttatgcttcataagatctgactggggtaagagataaagaggtaaatagggctgggcgcggtggctcacatctgtaatcccagcactttgggaagccgaggtgaacagatcacctgaagtcaggagttgaagaccaacttggccaacatggtgaaaccccatctctactaaaaatacaaaaattagccaggcatggtggtggacccctgtaatcccagctacttggaaggctgagggggaggattgcttaaacccaggaggcagaggttgcagtgagccgtgattgcaccactgcactccagcccaggtgacacagcaagactccgtctcaaaaaaaaaaaaaagaaaagaaaaaaaaaaaggaggtaaattagaactggttgcacacacatacaaacttcctgtgatgaatttaagaacagatcattacagggttagaatagtgacagattcaacaaaggatctgtttgatagggcaccaagggaacattttactggttcccacaaaaattaataaatgttaaatatcatgtcccaagcaatttcccatgtttttttattggtcctaatcaacagaatgttttgtgttccttccacttcacgttcagagcccacgtcatgccacttcctaaaagaccattagaccatccccttttcctccatcctccactgtagccttagccagagaaaagatccagctcacttctggtccaaaaaatgtcaacgtttggaaaatggctcatctacactacagaacacagccagatgacactgctaaagggtactgtaagaaaacacaaggtccaaagtatgctgaattggtttcataagtctaactcattggccagtgactgaaaaaccaggatatcaggattttctgggggccaatagccatgacccttgagctttcatagttcatgaaccactttgacataataaaatattcccaaaaccacctattccattcagtcccactcagcattaagagggggagggaaaaacaaaccaaccaaccaacctaacagttacattcaaatgtcaaatgaatgtgaacctagaaaatgtagtattaagagcatatcagaactagaaaagatttaagaatatctaattcattttacagtatagaaaactgagacccagagaaattaaatgacttgttcaaggtcatgcagttatttaatgacagatctgagaccagaacacgagtcttttggctattagtctaatgcattttctaccacacccactgcctctgagagcagtgatgctttggagaagatccatcaaagaatccatactgtaattggagacatagtcttatatgtcaatacgtatatgtcaatactacttggacacagcccttggaaatcacctgactgtaccaatacaaaccatactttggaaaccaccattctctgggtagaaacatctatggactatcaattttgtcagaaatcagtgaacaagtgaagagtcaattttttttagtcaaatattttctcttctcaatgaagagaagactaggacagtgacattttgaagcataccttttatactccttgtggttcttatgacagtctgtgatggtagtaggtaaagtagctaaatccttgattcagagaggggaaaacatgtggaaagaaactgaacgacttatccaagttcacatgacaagttagtggcagaaccattattgcaatccaggacttaagacatcttgtcctaggatttttcctccacattatattgcactgctctgaggcttgcttatatttttcatacctggatttccagggtggtgacgtgggggagggaagtattcaattcagaaccaccgtgaaccaagatctctggaaacaaactctgtactatttctccttcatctcctattttcataactagtgccaagctcaggactaactgcatagactccctttcaaaagaccaatagatattctcagtgacagttgaacacattagtttacaatcacacagaatttgaacagaacttaaagttgacagttaatgccgatctataattaacaaaaatgtcaacttgtggatatgctgatgattttatccagttttcaaaatatgattcctacagttcaggatatcacttattagattgtagacaaggaaaatgtacattgggacattatgtacttaagagtttttccttaagttttgcagaggaagtggttgaaaattgagctaacactagatttcgaggttactaaagaattccagttttccagtctcccacttcaattaccaggtaactataaggcaaaaatatcccaatgctgtgaacttaaggcaatattcatttcctttctacactacttggcatggtaaccatgacaaacttttattttctctttctgatttcctaatgaaatctcattatttgcaaagctttaaaatgactagatgaaggaaaaacattgttatgacccatgaccctcggagcccaaacagcaccatgaagagcatcattaaaactaagagaaagtggctatcagaaaatgaaacagctttaaaggggttccttttaagtcttgttttctattcagaatgttctgtgttttttctcaagtgtgggaatgacatttatcttagcaggttactcaactacactggatgatgtcactctaaccagtgtacggcactgacccaagtcctggggggctccttggaccaatggactattttacaaacctgggaggtgggagggatggtatatttttgataatcagacattccaatgtaatgttttccttagaggtcacacccttccccccattaatgtcatcgtgagatacatcaagtgtgttcttttctattttcgtataataaatgggctttgcttatcaacatcacaatggcaaagaagaaatatactgtacaaaactgcaggaagataaaacatgaaaactttctatgaaaaaaaaaaaacacccttgagtttcctgtcgtcttcttttgaaactgtagtgcatatgttaaaacatgtatatcatttacagtattgagtcgtgtgccactgctgtacctgatgtatccaatctggattaaacaaattatgtgccacaaaccctaaaa

SEQ ID NO: 23334 - DNA, 3887 bp, Homo sapiens
agcaagcggagcagcagcccgggcggcagcagcgtcgcggcggcggcggcagcggccgctccgcgcctcgcctcaccggcctcgctggcctcacctcgccgcgcccggacccgccacccccgcctccccgcccgacctccgcagcccccgtctcggccggcagcgcccaccgcctgcccgaagcgaggagcggagtgcggggcgcagaggcaccggagccagtgcccgccggccccgcaaatcaaacccagccaggagaacccccgcctggccccgtgcagctccgcgaccgccgggagctgtcccttcagcaccgccgcgggagcccaagtccgagcgcagcccagcggaaccccagctcgagcccgggctcacggagagcagcgctcggcgttagccgcacgagcaacaccccgggtgcccctgcccagggggcccgccatctcctccaggaggcggggagaaggaacgaggagggcgggcgggcaggcgggcccgccgccggggggagcaggcagccaagcaaggagagagggagggggccggagcccgccctgcgtcccgagctgcagcccggccacgcagggaggaaggcaggcggcatccatctcccccgcgccgagagcgcgccgcggcgaccacctcacagaggagcgcgaatttcccggccctgtctcctcccctccccctcctgggggctggcctctagtccggccccgggagcggctgacctttcccccaaaagctttgtgccgatttctccattttcccgcggagatggggacgggagcccggccccccaacccattttccccacctcccggggctcgctgctgagcccgcccccctccctctttccccctcactccctccctccctccctttctccctccctttctccctcccttctttcctcctctgcctcctccgctgccggaccagctccctcccacatctggctcctagagacccctgggatcccgcgcacattcccctggaccggcacccgacaaagcgcccggagaggcttggctcgctcgttggggtggccagagccgcaggcctctgttccccccgacggctggggggaggggggaagagggcgcgcgcccccctccccggcgccaactccccctggcggccgctcccatgggtgtcgctgggccgcgccatgcctaagggggcgccgcgatgggccaaggggacgagagcgagcgcatcgtgatcaacgtgggcggcacgcgccaccagacgtaccgctcgaccctgcgcacgctgcccggcacgcggctcgcctggctggcggagcccgacgcccacagccacttcgactatgacccgcgtgctgacgagttcttcttcgaccgccaccccggcgtcttcgcgcacatcctgaactactaccgcacgggcaagctgcactgcccagccgacgtgtgcgggccgctctacgaggaggagctggccttctggggcatcgacgagaccgacgtggagccctgctgctggatgacgtaccgccagcaccgcgacgccgaggaggctctggacagcttcggcggcgctcctctggacaacagcgccgacgacgcggacgccgacggccctggcgactcgggcgacggcgaggacgagctggagatgaccaagcgcctggcgctcagtgactccccggatggccggcctggcggcttttggcgccgctggcagccgcgcatctgggcgctcttcgaggacccgtactcgtcccgctacgcgcggtatgtggccttcgcttccctcttcttcatcctggtctccatcaccaccttctgcctggagacccacgagcgcttcaaccccatcgtgaacaagacggagatcgagaacgttcgcaatggcacgcaagtgcgctactaccgggaggccgagacggaggccttccttacctacatcgagggcgtctgtgtggtctggttcaccttcgagttcctcatgcgtgtcatcttctgccccaacaaggtagagttcatcaagaactcgctcaacatcattgactttgtggccatcctgcccttctacctggaggtggggctgagcggcctgtcctccaaggcagccaaggacgtgctgggcttcctgcgcgtcgtccgcttcgtgcgcatcttgcgcatctttaagctgacccgccactttgtgggcctgcgggtcctgggccacacgctccgagccagcaccaacgagttcctgctgctcatcatcttcctggccttgggcgtgctgatcttcgccaccatgatctactacgccgagaggataggggcacagcccaatgaccccagcgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcagattccaaactgaatggggaggtggcgaaggccgcgctggcgaacgaagactgcccccacatagaccaggccctcactcccgatgagggcctgccctttacgcgctcgggcacccgcgagagatacggaccctgcttcctcttatcaaccggggagtacgcgtgcccacctggtggaggaatgagaaaggatctttgcaaagaaagccctgtcattgctaagtatatgccgacagaggctgtgagagtgacttgaccaggcggcttggccgaggacactggtggctattaagcatctgggtggacctgcagcccctcctcaccctcggacagagtaaattcacgccatgcaggtttgccggacgagtccgagtggcccaggcattgtactaggacggacgtagctttttctacggccaaatggtaactgaccgtagaggatttcttttccttcttttcattttttaaaattttattttatttggggagggggggtggaggggctccttagcatgacttgcatgaagttaaacagaaaacccagcaaaccaaacccaccaaccccctgcaactgtatgattaccctgaacaacaataatgaaaagaaaaacatcaaagccctctattttctttcaaagctcttgactttcacacacgttgttggagccaaactgtaacggcgttcagtagaaacctgtacatttctgggggtgaggggcgaggggaggagggacagagatggggaatggattgcttcctttttgtacacaagatcaagaggaaagcttccaaaaagggcagtcggtcagtcatcggtcatattgacctcaccttcatagttcatctctcacgtggaaactgagaactttgctccaaatagaattgtggaaactcgcacggctgccttcttccccgtttggcatgcttgtgacccagcggatgtctccccaagacccctgacagcagctagtctaggttgattctctcatcttatcggtgtgtagatccagtgtgaccaactttcataacaaattgttcatagtaaataatcaccaccgtatggattttccaagtgttccattaaaaccaggatgtagagcaccaaaagatcaggaccacgggaggagcagcctcctccacctttactaaggcacaacctggcattgtatgcaatttagtacttcagagtaaaaa

SEQ ID NO: 23335 - DNA, 6766 bp, Homo sapiens
gggccgcgccatgcctaagggggcgccgcgatgggccaaggggacgagagcgagcgcatcgtgatcaacgtgggcggcacgcgccaccagacgtaccgctcgaccctgcgcacgctgcccggcacgcggctcgcctggctggcggagcccgacgcccacagccacttcgactatgacccgcgtgctgacgagttcttcttcgaccgccaccccggcgtcttcgcgcacatcctgaactactaccgcacgggcaagctgcactgcccagccgacgtgtgcgggccgctctacgaggaggagctggccttctggggcatcgacgagaccgacgtggagccctgctgctggatgacgtaccgccagcaccgcgacgccgaggaggctctggacagcttcggcggcgctcctctggacaacagcgccgacgacgcggacgccgacggccctggcgactcgggcgacggcgaggacgagctggagatgaccaagcgcctggcgctcagtgactccccggatggccggcctggcggcttttggcgccgctggcagccgcgcatctgggcgctcttcgaggacccgtactcgtcccgctacgcgcggtatgtggccttcgcttccctcttcttcatcctggtctccatcaccaccttctgcctggagacccacgagcgcttcaaccccatcgtgaacaagacggagatcgagaacgttcgcaatggcacgcaagtgcgctactaccgggaggccgagacggaggccttccttacctacatcgagggcgtctgtgtggtctggttcaccttcgagttcctcatgcgtgtcatcttctgccccaacaaggtagagttcatcaagaactcgctcaacatcattgactttgtggccatcctgcccttctacctggaggtggggctgagcggcctgtcctccaaggcagccaaggacgtgctgggcttcctgcgcgtcgtccgcttcgtgcgcatcttgcgcatctttaagctgacccgccactttgtgggcctgcgggtcctgggccacacgctccgagccagcaccaacgagttcctgctgctcatcatcttcctggccttgggcgtgctgatcttcgccaccatgatctactacgccgagaggataggggcacagcccaatgaccccagcgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcaggtaggaaacctcttagaggcatgtcgatctgacctttcacctctgccccctgtagcgatgattccagatccagtcagactgcttccttagttccgtgggtgaccccggaccccgcactcagtctggaggtgtggagcctgggggcccagggagatgctgggcggccaaattcagcaggcaagagcctgctagaggaacctcactggtgcccctgggtaaggaggttgacgcggttggtctcgtgatgttctgaagagacaacgcggcccgccaggttgctgaggactaacttagcaggagccaggggggctctgcttggtggggcaggagtccggtgtgagtctctgactcaggctactgacccggtgttgggacagagtgggggcgggtgtgatttggaaacgctagacagcctttgatctggtccttaccatggctcccttcaggctgtgtagatggcagagatggtgcatgggatctgggcaggagggtcccttgcaaaggcaggtgcaagggttctcacccccggcagagcctgtctccatagctgagtagaattcctgccctgatttcgggctgcccagctcgaggtccttcccaggagacgcctgtagccctccgtgacaagcttacttaccccatagcatgctgaaccaactcatcttctaccaccactctagagtttagcctttatctttaggaacctgttgaagtgactctagctttcacgttgtctgtttgggttgatggtcgagtgggagtttccggtgacccgatggaagcggctgccgagcaaaagactagagggggccaccaccctgggcagcttagatgaaagcgctacagaccagcaacagcctcccaccgagggttctccccgtttccagcggtagggactgcagcagcaatatagacatcccaaccagtgtacaaccactttcccgtgaattcactgggggccgggaggggggaggggggcatgaaacaatactagtcaccgtgggatatattctaatattccatggctagtggtttgttatgggactatctcagttttatgagaacctgcacatagcacataaagttgatcatggggctctggtccgaagatataaagcccatagtctacctctacccatggaataccatcgacttattctgtggacacagggatttcaaaggaacagatgacccagagaagaatgacagcactgagtaagaaggagtgccaggtgagcaggaggttgacgtgacaggtggcatttagtctatgaaggacctccccatgcccaggtctggcaggaggctgctggctagctcagccccaggtggggaagtttccccctggtttgggtggcctcccccagtggatgattgattttcttccctgctatcgcgctctctgacccaccaccccatcccaatcctcttctggctttaccccacagctatgctggcccgagcactaccctcaaggcccatttctttgcccatgggggtttcccggtcctttcaccctgccgcatacccttcccttcctgggatttctgtaggtgcctgagaggaacatggccaggggtctccgaggctgaaacagctccgagctctctgctttggattagctagttacttgatttcaggagctaccaacagggctctgggcctctaggaggaacgcgtgggctggcccaggccccagcttccatgtgggcctggcaagaagagctcagcctgagtggcatcactgtggcactacctggcccttcccctgcatcctccccgacactggatctttcaggagtgttgccccaagcacaggtgccctgggccagccagtcaagaatccccagtgctctccaggcaggcccagattcctctgtactcttggacaatgacagtattatcctgtgcggagtccccctgccccccagggagtgcagatgtgtttgttcagacatgcacaccagctaatcccaggacacaaaacctgtaaaacccatgcactcctgtgggattgcccctgagctccacagtctctccccagccctgcttttgagagccactttgccctggtcccaggtttcaggggcccagacagttctggcttggacagtctctgtggctgaggaagtatttggggccctcacaagcttgccctctggagcttggatgcctggatccctcctgcctcccccgtcaccaactgtgctcccaagcccttcccaagcactcacttcccggtggtgttggtgctgtcctgatatcctgacccccgaggctccagcctcatccctcaccagaacacttctccctccaaaagctggcgtgtgagaccccggctatccgccaccaagaggagttgcggtctttaggggcgttgtccccacctctgcaccccagagttcttcccattcaccttttttcctgcttgcagccatgcacctagatgggcatagggttggggtgagtttgtgggagagtgagggggaggccaggggcaaggaaggtaaatgtggtggccccacaggaattgtgagagatgagatgcagccccccaaggcctttccagtctcactgtacccccaaggcagtctagtggcctcgccaaaacctgagcttctccaattccacttttaaaaccagagttaggggctgtgtgtggcacgctgggttctgagggcatccctcccgcccccccaggccagcccccagtggtgccagcagcacctgcccctcacctccacctcttggtctcgtctgaagcctcagtctgtgtgtctgtcccagggacaatctggtctcctcctgtgtgctgtggctggcatggcctcagtgtctgagggcttgtcctgggaggggtatcaagaatccaattctcacctggttgtaggacctcttgggggatgctaggagggcgccctggcacagccagggattgcctagggctgaggggcccaggagaagctacttctctcccagaaaggggctccctcctgcatctgcagtcggatgcccagaccgcccactctggacagcccacaatgcctcctccgtcctgccatgcccattcgcatgtgtcttgtccatctccgctcctgtgatgtgggtcagtcctttgtggtgccgcgtccagggctgcagggtcccacgtcagtgagcagtgggtggccggtggagggggtggtggtggccgggctcccttcctgcccatggcacctagaacagcagtgaggtctcagagaagcccccgcctgggctccctgggagctaaccttgcagcctctgggttatctttggcaaaggggtctaaagtcccctatccccagcccctctacttcccctgctgggcagcagtggctgcccagtgagtggtgctatccatggaggggggagggagctgggcagcgctgactaggcggcgggtggggctaagagagtttctgcagggacccagctgcagggtcagcagcctgtgggccctgagtggggtctttgttgtcctcaggtgggctgtgggggaagtagcggagaaatgaagtgacgccaggggccaggcatgggtgttcttttccgtgttgttcacattttctctctttctctctctctccactaatcatgtttctctctctctcctcgttttgttgcatgacttgtgccggttctcgtgattgttccctgctcgtgtctcacagactgtccccatttagcctgagacttttttcctgagtccccagctgggcagatccctcagggctaaacccaaggaaatgcccagcaacccccaacccaccccagccccgcgtgcgcccctccggtgcccgcagctggtgtgaacagtaagtactttggcggtgcctggagaccagggcagaaaagccagctgtgctgactgagggcccagcctcgggttctccttgctccaaagtttaaaaaaaaatgaccctctcgcagatgctcatctcagcccatttcaagcctggaaaccatctctgagacgctgcccatgctgccatttcatcactgcaggcctgtgggtctagtgggggcctgggggccctgggctgggggaggcagggcccccagcctctggaaagcaggtgggaatggaggctcctagccactatctcatccaaaggatggggcaggggcgggggctcacacctttgaccctattcatgggttccccagatttatacagttggcccctcgttggtttctctttcttcaagccacccctctggagttggggagggagaatgccccagtttctgaaagcatcttaaaccatagatagacgaacagcccaggggcctgggccccttcacagagcaagacttaagcttccccacccaatcattagtccctcctcaaaggttagggttgagagaagcagtaggccctaggggtgtcccgggaatcccccaggagggaaaggtgccaggctatcatccctccagggatccctgatggatgttccttgtcccctgcccaaaaccatcccgaactttgggccctttagtgattgtgagagctgggagcccccagggcctgggggcttgtggacagaaccagtgggcgggggcccagcattcagagccagagaagggtctcaggcggcaccatctccacagaggcagaggcagagagaaggcacccccctctgacccacccctccccaggcaagaactgcaggctgtggacacctcccctggcagaggatggccaacagagactcagcaagtcctcactcccctcccagaaggagacgctgcctgggaggacccactgttctccccttgaggaaaatccatgcagggtgctatgggcctcaacccccacatcgtcatccgcgtcctctccatactgtttccctcccctctcccaacaccctcctccctcagcccggagacccttggatggaagactgggccagccagagtgggaggcaggaccagcgtgtctgcgagcacacgtgtgtgcctgcagacatgccccaagaccccagagacgccccggccccagtcacatggtgtcagagttaccttggcaactggcctttttggttcagagtaaattgggaagtgaagcccctgggatttgtcgagaaacgcactgtacgtgaaatgctttgccatcttgtacgaaagactttttttttaagttccaaaattatgatgggatttttttggatttgctttacgaataaatctgattggtccatttctcttttga

SEQ ID NO: 23336 - DNA, 3510 bp, Homo sapiens
gtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaagataactgcaaagaggttgtcattactggttacacgcaagccgaggccagatctcttacttaatgacttggggaaggcacaaaacatgagagaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctgggga

SEQ ID NO: 23337 - DNA, 3415 bp, Homo sapiens
gtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctgggga

SEQ ID NO: 23338 - DNA, 3344 bp, Homo sapiens
gtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagataactgcaaagaggttgtcattactggttacacgcaagccgaggccagatctcttacttaatgacttggggaaggcacaaaacatgagagaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctgggg

SEQ ID NO: 23339 - DNA, 3026 bp, Homo sapiens
agtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaagataactgcaaagaggttgtcattactggttacacgcaagccgaggccagatctcttacttaatgacttggggaaggcacaaaacatgagagaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaattatt

SEQ ID NO: 23340 - DNA, 5625 bp, Homo sapiens
gtggagagtggggtgtaaataaggcaggcagaagctccagagagggtggagacagagcttcacggaagaaaaatatgtgaacctggttggtacacatagcttctccagacccacccacccactctttcctgagccctgtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaaggatatgaaaaatcccgaagcttaaacaacatagcgggcttggcaggcaatgctctgaggctctctccagtaacatcaccctacaactctccttgtcctctgaggcgctctcgatctcccatcccatctatcttgtaaaccaaacaaccaaactgcatcagtcggctaaattgtattaattcaagtgctgtttaccccataatggaaataattaaatgtagagttactccaggctccattaatacagtataaatcttgcatgatactacaatttgaagtcagaaatgccacttgggtagctaatgaatcttacccaggctttaaagattgtctaaagtagtgctaagatccctcctattaattgccctgatatccttttgcaataaaatgacagatagtgtcagatattgaccagtgcactaatatataaacataccttcagggagatatatttaaaacagtgtgcttccaaatgccaaccacttcattggaactttatttcttgtgactgtaaaccattctgaagatgtctgggatcctatcttgattgcacacgacatgacttgtgtcagctcatttgcatggaccatcttgtctctatcacctgaaagcaatgttgcagagttcggggactgtggatagctcaggatatgtgtacttgcatcgaaccatcctgctgatatgaaagcattggtcgactgttctgcatgttgaattgtggggcagggagggcacttttctccttgacatttttttcttattatttgaaagaaatatatgttttaaatagtttaatttcttgattgatttacttttcttcaaaaatgctgtattggagttctgaatgtctctggttgtttgcacacagataactgcaaagaggttgtcattactggttacacgcaagccgaggccagatctcttacttaatgacttggggaaggcacaaaacatgagagaaaggtaactgccagccaggcttgcattgtttagccagaaattgctgcttggttctagactctttaaaaaaaaaaaatacccagggtttgtcatcattttcagaggcagagtgccaaatatcacccaaagctcttgtgtcttttttttacccccttattttatttttatttattaattttttgtgcaaacatcaaatgtcactggtgttcacagaaggcttttttgactagccttaaattcctgagtcaaaagattaatcagattttcaggcagtgtttaatcaggtgctttgtcctgtatgttgttcttgtctgtcttagctccctgtctttcctgtatatgccatctgtctccatgaagcacagaaatgcctctgtaagatgtttatgattttaatatttactccctccaaacccgactccataccattttttgctatttggagcagcctctctgctttgtgtataaattaatgatgctctgtagactacctaagttaatcggcactgtgaatctttttgataagcagggtttaagcagcaatttcaccattgcacttggttgcctgctgcagtgtcagtttctactacctagcaaccagcattcattactacactccaacaaaatccttagggagtcatattcagtctgagtggaagaaagtctatttatgcattcctatgaattcaacagcaatagcgtgtctcatgtattgagcatgtgagggaagaaaaagaccgtaatataaatagagggataaataatatcactaaggcatttgggagccttgagactgctgattaattcctatttctcatgtttattttttgttaggaagacaattgtcacttttattattggccacgaaacatgtattactctatatccccaagtcctagagcatgacctgcatgttggagatgttgtacagcaatgtatttatccagacatacatatatgatatttagagacacagtgattcttttgataacaccacacatagaacattataattacacacaaatttatggtaaaagaattaatatgctgtctggtgctgctgttattgactacagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaattat

SEQ ID NO: 23341 - DNA, 2931 bp, Homo sapiens
agtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaattatt

SEQ ID NO: 23342 - DNA, 5447 bp, Homo sapiens
cccagccacagccccgccccacctcccccaggccaatcagtttggttcctctcccctaagccacgcccccgctacctcgctcctcctcccacccaatcccgtcggtctctccccccgtgtccccgcccctgcgtccccgcccctcccgccccgccccccgtccaatgctgagctcagtctgcgtctcgtccttccgcgggcgccagggggccagcaagcagcagccggcgccaccgccgcagccgcccgagtccccgccgccgccaccgctgccgccgcagcagcagcagcctgcgcagcccggccccgccgcgtccccggcgggccccccggcaccccgcgggcccggggaccggcgcgccgagccatgccccgggctgccggcggcggccatggggcggcacggcggcggcggtggcgacagcggcaagatcgtgatcaacgtgggcggcgtgcgccatgagacgtaccgctcgacgctgcgcaccctgccggggacgcggctggccggcctgacggagcccgaggcggcggcacgcttcgactacgacccgggcgccgacgagttcttctttgaccggcacccgggagtcttcgcgtacgtgctcaactactaccgcaccggcaagctgcactgcccagccgacgtgtgcgggcccctgtttgaggaggagctcggcttctggggcatcgacgagaccgacgtggaggcctgctgctggatgacctaccggcagcatcgcgacgctgaggaggcgctcgactccttcgaggcgcccgaccccgcgggcgccgccaacgccgccaacgccgcaggcgcccacgacggaggcctggacgacgaggcgggcgcgggcggcggcggcctggacggagcgggcggcgagctcaagcgcctctgcttccaggacgcgggcggcggcgccggggggccgccagggggcgcgggcggcgcgggcggcacatggtggcgccgctggcagccccgcgtgtgggcgctcttcgaggacccctactcgtcgcgggctgccaggtatgtggccttcgcctccctcttcttcatcctcatctccatcaccaccttctgcctggaaacccatgagggcttcatccatattagcaacaagacggtgacccaggcctccccgatccccggggcacctccggagaacatcaccaacgtggaggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcagatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagctcttgtcaccgcctgagacctcgcgagactttcggtcccccccgccccttccccccaggttacgagaaatcccgcagcctcagcagcatcgcgggcctgagcggggtgtccctgcgcctcgcgccccttgccaccccccctggctctccccgggccgcccgccgcgctcccccgaccctgccctccatcctttagcgctcccctcccccctgtggggggactcgggggtgaccgggaagaaggtcaaaggagctgggggtggggggtggggaaaagggtttttttaaaaaaaatcaaaaagtcattaataatatgcaaccgagatgacgatgccagcagacacccccgggcccctcacccccaacctgggcccccaggatggagagaggggccacagcccgtccccccaactcttccctccccaaaaaaagccttctcaggtctccacgagccataggacatccccctgccatcaacttgtgtaaataagtccaaattatgccagttacatcttggggcacctccccccacacactgcatgccttccctaacctggagcccccactccaagtccacctcagcaataagccgccaggggccgcatgcgcgggtttgaggggcaggcactctgggaagggggtggcacctcccgggggtcgggctggcctttaaggtctccagccttcccatccttcaccccaggaggacaaccaaccctgtgcgttgattaggagaaaacaaaccagaaactagaaacagtgtaggggaaggaggaacagttacccaagccccagatcggagttgagctcaggtggcgggagggcggggccgagttgagctcaggtggtgggagggcggggcgggctttggacctgctccctcagcctttaggagaattcctctggtgaatttcaccctctcatccgccccttcccccagggacctgctcgcctctattcttgctgcatggactcagacctcctatcccagaattcctgggatgatctggccctagcacacgaaattccccgactatctccctccattcccaggacatgagacctgcacccagaattctgagactgaccctggcacgccacatctcccaatccccacacactcctgcgacttaacctctgcacacagaggctccctgaaccaccctccctccccactcctgccaccccaaacacccccaccaaattccctgaactgcgtcccagcacttctcaaacctccaagacttgacccagctcttttcagctcaaattcagcctttgggatgctccaaatccttcccacaactgacatttcttggacacccccaaagcctcaggcctgttccgcacccatatccccaaagccctaacagacttgtccagcccaggttcccttgatgctagaacttccaagataggcgcaacctgtctgcaattccagggaaccagaccctccccaagcaccctctttgtcttacgcctaaccctgagtctcttccctgagatggtgccccaaaggtaccctcttcacagacaccagtgtttcccagagggttgtatttgtacctttggtggtgtgctaaggtttgaggcagtatgaggacaaacacttgttttaaaagttttgtctctaatacgcattttgtacagaagccgataagtgcaggcatcgctgcttggctaggacacggtttatttaggttaagagtgtttccatttaaagtagtccacagatgatcacagaggctgttcccgaagggaggaacactggagtatcagaagattgggaaccgacaacacccagctcggctgggatcccagccccccttccccagcggtcctcaccgcgtcacgctcgcgggtggaaaatcatttcccacctcctatcctggctcaaggatgcgctacctcccccaagcccagagaccacaccggtcccagactctttagcggaccccccttttggagccggggtcccacggaattagccacctccctccctctgctcccacggcctcaggaaccccccacccgagggtggatggggggcgtcactgagcacgattctcgatgcaacgattcctatgcaaggggcattttgagtcccccccatccttccctcggaccctaaaccctggtgaagcaggggtgaggggtggggcgggttttggtgggggcggggcaaagggctaggggctccagacaccagggtacggggtggggactgattatattgccaaagggttcaacttctttaacaagcccccccgtttcccctgaccttcacgaaagccgaaggaggcggggaaagggggtgagggtcttttccaaagggtactgacctcttcccaacgtctccccctgctcgccagtccgccacacgtacccagcttttgagttcagcttttcaaaataaccacaatcatgataaacttctacaaaacgtgattctcctcccctcccaccccatcccccaagtcaatagtgtgggattcggggagggagagagcgagctaaagggactctttccaagtccggctcccccttttccccccggccgccagggtgcctgcacctacacgcatgcgctgcatgacgcgccccccacacgcatgtcgcacccctcctgcgctccgggaacgcacggacacgggccagggggcggggcgattggggaggaatgaatggcggggggtcttcctgagctccgcggctcaccctccccaacacacacacacacacacacagagcaataagtttctctcactcaaatgtgggcggggcgggcctagcctgtcgctggtggggggagtggtgagggggcgctctcagggatgggggcggggttcggagacagtgtggggaggggaggtctgcaaatcgtccaactctggtgctaatggcgggtcttctcagcccacccgcagggcagggagggaggggtcggcgtggccccttccccaagcctcccccacgcccaccctgggtgcatgaaccgcccaatgcagaagctgccgcatgtcacccccctctccccaaagaaaaagtgtcatgcccccttcccacccaccctcactccccaccaaaataaacgtttccttttcatttaaaaa

SEQ ID NO: 23343 - DNA, 3347 bp, Homo sapiens
aggtcgcgacggcagccacaggtggcagtcgggggtggctgtaattgatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagctcttgtcaccgcctgagacctcgcgagactttcggtcccccccgccccttccccccaggttacgagaaatcccgcagcctcagcagcatcgcgggcctgagcggggtgtccctgcgcctcgcgccccttgccaccccccctggctctccccgggccgcccgccgcgctcccccgaccctgccctccatcctttagcgctcccctcccccctgtggggggactcgggggtgaccgggaagaaggtcaaaggagctgggggtggggggtggggaaaagggtttttttaaaaaaaatcaaaaagtcattaataatatgcaaccgagatgacgatgccagcagacacccccgggcccctcacccccaacctgggcccccaggatggagagaggggccacagcccgtccccccaactcttccctccccaaaaaaagccttctcaggtctccacgagccataggacatccccctgccatcaacttgtgtaaataagtccaaattatgccagttacatcttggggcacctccccccacacactgcatgccttccctaacctggagcccccactccaagtccacctcagcaataagccgccaggggccgcatgcgcgggtttgaggggcaggcactctgggaagggggtggcacctcccgggggtcgggctggcctttaaggtctccagccttcccatccttcaccccaggaggacaaccaaccctgtgcgttgattaggagaaaacaaaccagaaactagaaacagtgtaggggaaggaggaacagttacccaagccccagatcggagttgagctcaggtggcgggagggcggggccgagttgagctcaggtggtgggagggcggggcgggctttggacctgctccctcagcctttaggagaattcctctggtgaatttcaccctctcatccgccccttcccccagggacctgctcgcctctattcttgctgcatggactcagacctcctatcccagaattcctgggatgatctggccctagcacacgaaattccccgactatctccctccattcccaggacatgagacctgcacccagaattctgagactgaccctggcacgccacatctcccaatccccacacactcctgcgacttaacctctgcacacagaggctccctgaaccaccctccctccccactcctgccaccccaaacacccccaccaaattccctgaactgcgtcccagcacttctcaaacctccaagacttgacccagctcttttcagctcaaattcagcctttgggatgctccaaatccttcccacaactgacatttcttggacacccccaaagcctcaggcctgttccgcacccatatccccaaagccctaacagacttgtccagcccaggttcccttgatgctagaacttccaagataggcgcaacctgtctgcaattccagggaaccagaccctccccaagcaccctctttgtcttacgcctaaccctgagtctcttccctgagatggtgccccaaaggtaccctcttcacagacaccagtgtttcccagagggttgtatttgtacctttggtggtgtgctaaggtttgaggcagtatgaggacaaacacttgttttaaaagttttgtctctaatacgcattttgtacagaagccgataagtgcaggcatcgctgcttggctaggacacggtttatttaggttaagagtgtttccatttaaagtagtccacagatgatcacagaggctgttcccgaagggaggaacactggagtatcagaagattgggaaccgacaacacccagctcggctgggatcccagccccccttccccagcggtcctcaccgcgtcacgctcgcgggtggaaaatcatttcccacctcctatcctggctcaaggatgcgctacctcccccaagcccagagaccacaccggtcccagactctttagcggaccccccttttggagccggggtcccacggaattagccacctccctccctctgctcccacggcctcaggaaccccccacccgagggtggatggggggcgtcactgagcacgattctcgatgcaacgattcctatgcaaggggcattttgagtcccccccatccttccctcggaccctaaaccctggtgaagcaggggtgaggggtggggcgggttttggtgggggcggggcaaagggctaggggctccagacaccagggtacggggtggggactgattatattgccaaagggttcaacttctttaacaagcccccccgtttcccctgaccttcacgaaagccgaaggaggcggggaaagggggtgagggtcttttccaaagggtactgacctcttcccaacgtctccccctgctcgccagtccgccacacgtacccagcttttgagttcagcttttcaaaataaccacaatcatgataaacttctacaaaacgtgattctcctcccctcccaccccatcccccaagtcaatagtgtgggattcggggagggagagagcgagctaaagggactctttccaagtccggctcccccttttccccccggccgccagggtgcctgcacctacacgcatgcgctgcatgacgcgccccccacacgcatgtcgcacccctcctgcgctccgggaacgcacggacacgggccagggggcggggcgattggggaggaatgaatggcggggggtcttcctgagctccgcggctcaccctccccaacacacacacacacacacacagagcaataagtttctctcactcaaatgtgggcggggcgggcctagcctgtcgctggtggggggagtggtgagggggcgctctcagggatgggggcggggttcggagacagtgtggggaggggaggtctgcaaatcgtccaactctggtgctaatggcgggtcttctcagcccacccgcagggcagggagggaggggtcggcgtggccccttccccaagcctcccccacgcccaccctgggtgcatgaaccgcccaatgcagaagctgccgcatgtcacccccctctccccaaagaaaaagtgtcatgcccccttcccacccaccctcactccccaccaaaataaacgtttccttttcattt

SEQ ID NO: 23344 - DNA, 3049 bp, Homo sapiens
accggtcccgcctcccttgacgccccgccccgcccctcctccctgctctcttagaaagagccaatcgctccgtctcattggcggccccgactcgtccagctgggtcgcgttagagtgcccgccccactcctcccagccacagccccgccccacctcccccaggccaatcagtttggttcctctcccctaagccacgcccccgctacctcgctcctcctcccacccaatcccgtcggtctctccccccgtgtccccgcccctgcgtccccgcccctcccgccccgccccccgtccaatgctgagctcagtctgcgtctcgtccttccgcgggcgccagggggccagcaagcagcagccggcgccaccgccgcagccgcccgagtccccgccgccgccaccgctgccgccgcagcagcagcagcctgcgcagcccggccccgccgcgtccccggcgggccccccggcaccccgcgggcccggggaccggcgcgccgagccatgccccgggctgccggcggcggccatggggcggcacggcggcggcggtggcgacagcggcaagatcgtgatcaacgtgggcggcgtgcgccatgagacgtaccgctcgacgctgcgcaccctgccggggacgcggctggccggcctgacggagcccgaggcggcggcacgcttcgactacgacccgggcgccgacgagttcttctttgaccggcacccgggagtcttcgcgtacgtgctcaactactaccgcaccggcaagctgcactgcccagccgacgtgtgcgggcccctgtttgaggaggagctcggcttctggggcatcgacgagaccgacgtggaggcctgctgctggatgacctaccggcagcatcgcgacgctgaggaggcgctcgactccttcgaggcgcccgaccccgcgggcgccgccaacgccgccaacgccgcaggcgcccacgacggaggcctggacgacgaggcgggcgcgggcggcggcggcctggacggagcgggcggcgagctcaagcgcctctgcttccaggacgcgggcggcggcgccggggggccgccagggggcgcgggcggcgcgggcggcacatggtggcgccgctggcagccccgcgtgtgggcgctcttcgaggacccctactcgtcgcgggctgccaggtatgtggccttcgcctccctcttcttcatcctcatctccatcaccaccttctgcctggaaacccatgagggcttcatccatattagcaacaagacggtgacccaggcctccccgatccccggggcacctccggagaacatcaccaacgtggaggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcagatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagctcttgtcaccgcctgagacctcgcgagactttcggtcccccccgccccttccccccaggttagcaattgggaatggctgggagggggtgtccccaagacactgggcttcaaatctccccccaagccctccctcctacgatcaagacaccttttgtccagacagctcccttagcgttgcctggaaaagccacagagctccctgcgggggtgcagaaccctgcaggcagccccaggctttgcagaaaccacacacactgttgctggatcttgagtcccattagctgtgagatgcctgtgagagccttcccgcacccgtcagaagctcagagccttcttggaccctttaaagatgtccctctccccagccctccgcctcaccgccccccacccccgaccccgtccttagaatcttctggaggagcctccctccccccccacccccccccactgctcctggagttctcatcggattccccaagggcactgccagcttcgctccactcagcccccttgcagaccccaccccctgcctgctctctttccctacaactaggtcagcccccagccccgctacggcggccgc

SEQ ID NO: 23345 - DNA, 3176 bp, Homo sapiens
accggtcccgcctcccttgacgccccgccccgcccctcctccctgctctcttagaaagagccaatcgctccgtctcattggcggccccgactcgtccagctgggtcgcgttagagtgcccgccccactcctcccagccacagccccgccccacctcccccaggccaatcagtttggttcctctcccctaagccacgcccccgctacctcgctcctcctcccacccaatcccgtcggtctctccccccgtgtccccgcccctgcgtccccgcccctcccgccccgccccccgtccaatgctgagctcagtctgcgtctcgtccttccgcgggcgccagggggccagcaagcagcagccggcgccaccgccgcagccgcccgagtccccgccgccgccaccgctgccgccgcagcagcagcagcctgcgcagcccggccccgccgcgtccccggcgggccccccggcaccccgcgggcccggggaccggcgcgccgagccatgccccgggctgccggcggcggccatggggcggcacggcggcggcggtggcgacagcggcaagatcgtgatcaacgtgggcggcgtgcgccatgagacgtaccgctcgacgctgcgcaccctgccggggacgcggctggccggcctgacggagcccgaggcggcggcacgcttcgactacgacccgggcgccgacgagttcttctttgaccggcacccgggagtcttcgcgtacgtgctcaactactaccgcaccggcaagctgcactgcccagccgacgtgtgcgggcccctgtttgaggaggagctcggcttctggggcatcgacgagaccgacgtggaggcctgctgctggatgacctaccggcagcatcgcgacgctgaggaggcgctcgactccttcgaggcgcccgaccccgcgggcgccgccaacgccgccaacgccgcaggcgcccacgacggaggcctggacgacgaggcgggcgcgggcggcggcggcctggacggagcgggcggcgagctcaagcgcctctgcttccaggacgcgggcggcggcgccggggggccgccagggggcgcgggcggcgcgggcggcacatggtggcgccgctggcagccccgcgtgtgggcgctcttcgaggacccctactcgtcgcgggctgccaggtatgtggccttcgcctccctcttcttcatcctcatctccatcaccaccttctgcctggaaacccatgagggcttcatccatattagcaacaagacggtgacccaggcctccccgatccccggggcacctccggagaacatcaccaacgtggaggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcagatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagccactggtgctcccccactgcccccccaagactggcgtaagccaggccccccaagcttcttgcccgacctcaacgccaacgccgcggcctggatatccccctagtggacgaaccccctccccccgggctcttgtcaccgcctgagacctcgcgagactttcggtcccccccgccccttccccccaggttagcaattgggaatggctgggagggggtgtccccaagacactgggcttcaaatctccccccaagccctccctcctacgatcaagacaccttttgtccagacagctcccttagcgttgcctggaaaagccacagagctccctgcgggggtgcagaaccctgcaggcagccccaggctttgcagaaaccacacacactgttgctggatcttgagtcccattagctgtgagatgcctgtgagagccttcccgcacccgtcagaagctcagagccttcttggaccctttaaagatgtccctctccccagccctccgcctcaccgccccccacccccgaccccgtccttagaatcttctggaggagcctccctccccccccacccccccccactgctcctggagttctcatcggattccccaagggcactgccagcttcgctccactcagcccccttgcagaccccaccccctgcctgctctctttccctacaactaggtcagcccccagccccgctacggcggccgc

SEQ ID NO: 23346 - DNA, 3670 bp, Homo sapiens
ccaagccggagccccgcagcgcttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtggggctgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgcctgcttcctgctcagcactggggactatgcctgcgccgatggtagtgtccggaaaggcacattcgtcctccgtgaccttccccttcagcattcacctgaggctgcatgccctccaactgctgggactctgttcctgccacattgaggaagggggctgggcacgacatggcatcatactcaggagccttcttcaccagctccttgggacaatggaatatcccagggtggtgacagcagatggagctacttgggggagagctcaagttggtcaggcaacagctggggtgatggcctgtgagccacaggccacatcaggaactttccccactgcctccatgcaaggctgcagagctatggtccctttctccactgcactggagctttgaagacctaagaggctagtggttcctggagctagtggttacctgaacaggtatggcgatgagctacaacatcacctgagtcaccagagttgggttggcagaggggtgaagggttcaccccattccctgacccatccatgctcttcctggccttttagccctgggttcctcatgccttccagctctgctcctggtctactccttagcccacaccctgtgggtcagcagctggcttccttctaacgtctcattctttgtttctccctttcttttgctgaactccctgtccccccaaccccagaaggcaatgttgagccgaaagcgtgcgtcccagtgtctcacacctgtgctctttaaacacagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcacgtgctattggtggtttgtcttctttgttaggctgtgtctccctaagcccttgccccacccagagtttcccgtccccttcactgatttctgttgtttctgctgactgtgtgggtggaatgtcccaagaaaagtgcatctgggaattgccagtccagctgggtagtcccaggctcctgtcttggggatgtttcccctgtcagcaagtaacctggtgaagtctattgaaggccagactgccccctagggtcactgcttcactagccgcaccccaccccagattggggttctacctcccaccccacatcctcgttgtggggggacttccaggggctcctctgcagcctcctccactacttcctccaccccatctatgtccttgacttaggggggcattttgtcttttttagatttgattttgttctctctcctttgtctgtttgttgtcaaagatgctgctgggcagacaggcagggaaaggatctgtctgcccatctggcccagggggtccgagaagggaagccttgggcaagaggagaccagttgcaatactgtacttcctggtcagtggccagaggatgcgtgcaatagcagaggccaggtgaccccttcagccttggcctctgcccctcccttggccctccctccctgctcctccctggtgttggtcagtccttttctaaagctgtcccctcgtgtgtgtctggggcatgcccaggctgggccctgtgccctgtctgcatgcctccaactgtcatgctgtgctcgagccccaataaagacatctggagcatcctgctgctcctgctgtgtga

SEQ ID NO: 23347 - DNA, 2953 bp, Homo sapiens
atgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtggggctgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgcctgcttcctgctcagcactggggactatgcctgcgccgatggtagtgtccggaaagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcacgtgctattggtggtttgtcttctttgttaggctgtgtctccctaagcccttgccccacccagagtttcccgtccccttcactgatttctgttgtttctgctgactgtgtgggtggaatgtcccaagaaaagtgcatctgggaattgccagtccagctgggtagtcccaggctcctgtcttggggatgtttcccctgtcagcaagtaacctggtgaagtctattgaaggccagactgccccctagggtcactgcttcactagccgcaccccaccccagattggggttctacctcccaccccacatcctcgttgtggggggacttccaggggctcctctgcagcctcctccactacttcctccaccccatctatgtccttgacttaggggggcattttgtcttttttagatttgattttgttctctctcctttgtctgtttgttgtcaaagatgctgctgggcagacaggcagggaaaggatctgtctgcccatctggcccagggggtccgagaagggaagccttgggcaagaggagaccagttgcaatactgtacttcctggtcagtggccagaggatgcgtgcaatagcagaggccaggtgaccccttcagccttggcctctgcccctcccttggccctccctccctgctcctccctggtgttggtcagtccttttctaaagctgtcccctcgtgtgtgtctggggcatgcccaggctgggccctgtgccctgtctgcatgcctccaactgtcatgctgtgctcgagccccaataaagacatctggagcatcctgctgctcctgctgtgtga

SEQ ID NO: 23348 - DNA, 3487 bp, Homo sapiens
gggggataggcaggggcaagcccaagccgcagagggggccgccaccgcctcctgcctcctcttcgtctcctccccctcccccgtctgacgctgcctcctcgggaagggtgtttggagggcagcggccgccccaagccggagccccgcagcgcttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtggggctgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgcctgcttcctgctcagcactggggactatgcctgcgccgatggtagtgtccggaaaggcacattcgtcctccgtgaccttccccttcagcattcacctgaggctgcatgccctccaactgctgggactctgttcctgccacattgaggaagggggctgggcacgacatggcatcatactcaggagccttcttcaccagctccttgggacaatggaatatcccagggtggtgacagcagatggagctacttgggggagagctcaagttggtcaggcaacagctggggtgatggcctgtgagccacaggccacatcaggaactttccccactgcctccatgcaaggctgcagagctatggtccctttctccactgcactggagctttgaagacctaagaggctagtggttcctggagctagtggttacctgaacagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcacgtgctattggtggtttgtcttctttgttaggctgtgtctccctaagcccttgccccacccagagtttcccgtccccttcactgatttctgttgtttctgctgactgtgtgggtggaatgtcccaagaaaagtgcatctgggaattgccagtccagctgggtagtcccaggctcctgtcttggggatgtttcccctgtcagcaagtaacctggtgaagtctattgaaggccagactgccccctagggtcactgcttcactagccgcaccccaccccagattggggttctacctcccaccccacatcctcgttgtggggggacttccaggggctcctctgcagcctcctccactacttcctccaccccatctatgtccttgacttaggggggcattttgtcttttttagatttgattttgttctctctcctttgtctgtttgttgtcaaagatgctgctgggcagacaggcagggaaaggatctgtctgcccatctggcccagggggtccgagaagggaagccttgggcaagaggagaccagttgcaatactgtacttcctggtcagtggccagaggatgcgtgcaatagcagaggccaggtgaccccttcagccttggcctctgcccctcccttggccctccctccctgctcctccctggtgttggtcagtccttttctaaagctgtcccctcgtgtgtgtctggggcatgcccaggctgggccctgtgccctgtctgcatgcctccaactgtcatgctgtgctcgagccccaataaagacatctggagcatcctgctgctcctgctgtgtga

SEQ ID NO: 23349 - DNA, 2288 bp, Homo sapiens
ttgtgtttagaaaaggctcgggcaaagccagcccaagttcgctctctgcacacctcgagcacctcgcggacggcgtgggtccgccagctccgggacctgccgccgctgcctgcgcgccccggggcggaggacggtgccagccgcccacgaggagaccccgctcccgcaggaggccgagctgaagcggcggagcgcgccgccagccagccggggtgagtgccccgggcgaggccggcggccgccaaagcccccgcgggctcgcccgggcgcccggatgccagccccgagccccgccgccgggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggcgcggggcggaggctgcgagggcgcgcgcggggaggatggacgggtccggggagcgcagcctcccggagccgggcagccagagctccgctgccagcgacgacatagagatagtcgtcaacgtggggggcgtgcggcaggtgctgtacggggacctcctcagtcagtaccctgagacccggctggcggagctcatcaactgcttggctgggggctacgacaccatcttctccctgtgcgacgactacgaccccggcaagcgcgagttctactttgacagggacccggacgccttcaagtgtgtcatcgaggtgtactatttcggggaggtccacatgaagaagggcatctgccccatctgcttcaagaacgagatggacttctggaaggtggacctcaagttcctggacgactgttgcaagagccacctgagcgagaagcgcgaggagctggaggagatcgcgcgccgcgtgcagctcatcctggacgacctgggcgtggacgcagccgagggccgctggcgccgctgccagaagtgcgtctggaagttcctggagaagcccgagtcgtcgtgcccggcgcgggtggtggccgtgctctccttcctgctcatcctcgtctcgtccgtggtcatgtgcatgggcaccatccccgagctgcaggtgctggacgccgagggcaaccgcgtggagcacccgacgctggagaacgtggagacggcgtgcattggctggttcaccctggagtacctgctgcgcctcttctcgtcacccaacaagctgcacttcgcgctgtccttcatgaacattgtggacgtgctggccatcctccccttctacgtgagcctcacgctcacgcacctgggtgcccgcatgatggagctgaccaacgtgcagcaggccgtgcaggcgctgcggatcatgcgcatcgcgcgcatcttcaagctggcccgccactcctcgggcctgcagaccctcacctatgccctcaagcgcagcttcaaggaactggggctgctgctcatgtacctggcagtgggtatcttcgtcttctctgccctgggctacaccatggagcagagccatccagagaccctgtttaagagcatcccccagtccttctggtgggccatcatcaccatgaccaccgtcggctacggcgacatctaccccaagaccacgctgggcaagctcaacgcggccatcagcttcttgtgtggtgtcatcgccatcgccctgcccatccaccccatcatcaacaactttgtcaggtactacaacaagcagcgcgtcctggagaccgcggccaagcacgagctggagctgatggaactcaactccagcagcgggggcgagggcaagaccgggggctcccgcagtgacctggacaacctccctccagagcctgcggggaaggaggcgccgagctgcagcagccggctgaagctctcccacagcgacaccttcatccccctcctgaccgaggagaagcaccacaggacccggctccagagttgcaagtgacaggagggcccctcaggcagagatggaccaggcggtggacagatgggtagatgtggcaggcatgtcatcgacagcacagaagggctgtcctgtgtccccccaaccctcccctggacagactctgaaggccctcccggcacctctgccaaggctgggtaagactcctctatgttgcctgctgtccaggagcccgggagggaggggtgtgcaggagccgcagggccgtgtgggacgagtggaggccgcggcctggctggcacgagagcccacgcccgcttctgtatctccctcaataaagcctcctgctctgtgc

SEQ ID NO: 23350 - DNA, 2211 bp, Homo sapiens
gctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgaggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcagggccactgttcccagatgtgccacaacgtcttcatcgtggagtcggtgtgcgtgggctggttctccctggagttcctcctgcggctcattcaggcgcccagcaagttcgccttcctgcggagcccgctgacgctgatcgacctggtggccatcctgccctactacatcacgctgctggtggacggcgccgccgcaggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatcctgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagca

SEQ ID NO: 23351 - DNA, 2168 bp, Homo sapiens
ggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgaggtgggaactttgcgcgctgcagcctcgccgggcgccaccaaagcgcgaaccggaccccgagcctgcaaactcgggctcgggggcggctgcacgtggccgtggccctgaactccctgcgggggcctcgaaacccgcctgcggggaggccagggcgacagaggactcgggagtcaccgctggtgcgtggcggcgtggagcgcgcttgttacggccaagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcaggtaagagcccacgccccgcggggaaacgcgccaccacgagggaagggactctgagcattgtcacctcctccagaaagcctcctctgattgcacactggctgaatagcatccctggtccctcctgacatcaggaatgtttgtgtgcatggtctgcctccctgttaatatgtgagcatcatgggggtccacgcctgtgcctgtcctggcctccactgtgcccaccactgccctcccccttgccagtgtttagaacagtgtccagcacaaacaggcactcaaccactatttgttgaatgaacaaatgagtgaataaatgggtggtgtgatttttgacgtgcctggccctgagcgaagcacattacatatatcatcaaatttatctcaaccattcggtcctttctcaacgttcctaatcctttgcatcatagtagcccagacacattttctgggtcctgaagataatttttattgataggtatatgtgtgtctacaaatggtgagcatttctttttgttacataagagaatgaatggaaagtttatttactccagggcctgacacggggtgtgtgctacagtctaagggctcccactcatctgggagttcacgggagccggagctgggctgcatgtgccaactacgtcttatctccctagggaatgctccagcaaccctgtgggggaagtgttttcacacccactaggtatttgaggacactgcccaaccccaggtctaagtccagtctgtctttgtaagcatggaaatatggtgtccacgtggcagcttggggacctaatatagccccacaggactatgtgattggcccacacaaggtttcccaaaaatttgacttggttgccaacaataaaagtgaagttttttc

SEQ ID NO: 23352 - DNA, 967 bp, Homo sapiens
ggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgagatgaaacagcagagctgaaaagagagatcaccaaggaaagtgcctgaaagggattattcccacgcctccaaaggatcctggcaggctgtgcctgaggagatgggttccaattttagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtgga

SEQ ID NO: 23353 - DNA, 802 bp, Homo sapiens
aggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgaggtgggaactttgcgcgctgcagcctcgccgggcgccaccaaagcgcgaaccggaccccgagcctgcaaactcgggctcgggggcggctgcacgtggccgtggccctgaactccctgcgggggcctcgaaacccgcctgcggggaggccagggcgacagaggactcgggagtcaccgctggtgcgtggcggcgtggagcgcgcttgttacggccaagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaa

SEQ ID NO: 23354 - DNA, 1096 bp, Homo sapiens
gcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcag

SEQ ID NO: 23355 - DNA, 608 bp, Homo sapiens
ctgctgccgagacaggatcactttccacacaggaaactcacgtgggggcagggcgtgaaggaaataaatcactaattgggggagttttctgctggagggaaagctgggagggttgaaagaagaaattcctaaaaagaagaggtgattacagccatggggattcacaagagccctccagggcttgtgtgaggcattttccgtttacctccatcaccattcttgccaaacagaatgtcactttttctcttttctgtggtagcaaagatgaaacagcagagctgaaaagagagatcaccaaggaaagtgcctgaaagggattattcccacgcctccaaaggatcctggcaggctgtgcctgaggagatgggttccaattttagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccg

SEQ ID NO: 23356 - DNA, 3824 bp, Homo sapiens
gcggcgcggagggaggtgagcggcgcgcgcggagccggcgggcgaggaggaggactgcacagaggccccgcccccgccgccgcgagccggctcttcgccgcctccgaacccgctcactttgcctctcgcctctggacggcggcggggcggccgccggattcgcggccgcagggagcgccggagacggggagctattccgccccggcggctccattcggcgcccgcagccctcagggggtcggccccgcggcttgggagagggcaccgcggcctcggtgtgcgcagccctcgggcgcgagggtcggcggcgcggacacagccgcgttcccagccggtggggctcagcgctggcgccggcgaggactccccggccacccgcaggtaccgccgggcggagggcgcgctactagcagcgccggagatactcgagcccagggacccccgggccagcggagggcaggagcggagccccgagggagcgcgggccccgacggcgcgctcccccgtcagccacgggcaggcaggccccgcgtggcggcttggggtggggggctgcagcggggccctcgggccgaaagtcccccgggcggccagccatgaccttcgggcgcagcggggcggcctcggtggtgctgaacgtgggcggcgcccggtattcgctgtcccgggagctgctgaaggacttcccgctgcgccgcgtgagccggctgcacggctgccgctccgagcgcgacgtgctcgaggtgtgcgacgactacgaccgcgagcgcaacgagtacttcttcgaccggcactcggaggccttcggcttcatcctgctctacgtgcgcggccacggcaagctgcgcttcgcgccgcggatgtgcgagctctccttctacaacgagatgatctactggggcctggagggcgcgcacctcgagtactgctgccagcgccgcctcgacgaccgcatgtccgacacctacaccttctactcggccgacgagccgggcgtgctgggccgcgacgaggcgcgccccggcggggccgaggcggctccctccaggcgctggctggagcgcatgcggcggaccttcgaggagcccacgtcgtcgctggccgcgcagatcctggctagcgtgtcggtggtgttcgtgatcgtgtccatggtggtgctgtgcgccagcacgttgcccgactggcgcaacgcagccgccgacaaccgcagcctggatgaccggagcaggtactccgccggccctgggagggagccctccgggataattgaagctatctgcataggttggttcactgccgagtgcatcgtgaggttcattgtctccaaaaacaagtgtgagtttgtcaagagacccctgaacatcattgatttactggcaatcacgccgtattacatctctgtgttgatgacagtgtttacaggcgagaactctcaactccagagggctggagtcaccttgagggtacttagaatgatgaggattttttgggtgattaagcttgcccgtcacttcattggtcttcagacactcggtttgactctcaaacgttgctaccgagagatggttatgttacttgtcttcatttgtgttgccatggcaatctttagtgcactttctcagcttcttgaacatgggctggacctggaaacatccaacaaggactttaccagcattcctgctgcctgctggtgggtgattatctctatgactacagttggctatggagatatgtatcctatcacagtgcctggaagaattcttggaggagtttgtgttgtcagtggaattgttctattggcattacctatcacttttatctaccatagctttgtgcagtgttatcatgagctcaagtttagatctgctaggtatagtaggagcctctccactgaattcctgaattaatgcattgcaaatcaattcttgcatacacttcatagaaagactttgatgctgcttcatatttatgtgtttcttgctgggtgagcactgcagtggcattgtcatcatcttggtagggtaaaaattatccttcccagccgaagggataaaacagtttacttgttatggagtaaatagaattgagactgcaaaggaagaataatgactcctagagtaaactttaggacccggttttatttagacttgttttcccgtttccttgaatgattacacatttttaaaaaatacattatttgaacattttaaaacagaaaggtactattttccaaatgtttttccatcttatgaattcagaagaagcttggaacttatagtgttttttgtttgagagtaacattttcatttctaaatgttttataatttctcatatcaatgtcagaagtatcctggaaacatatgtcacatgcgggaactgtttaacaaatactttaaaaatttggccaaaatttaaactgtataatggagctagatacaagcaagaatagtatttgaaagacttttccagcatacttctcaattctttgctttatttttgtgccaattattcaccttatcgtgccgcttcatggaagcttgagtatgttctcccttttccattttggatttatctctttactgtaatgactcaaaaggtatttaagaattgacgagagcttgtgttgtttagcatcttactggataatatttgaattcattgctgttcctaggtgataactgtcctaatatttagatgtccaaacaagaatacttccaacataaaaattataataggaataatttgagatgactcaatattacaacctcttcttctcttaacctcctcccccaaacactagaggtttaataagacttatcagatgaaaggatatttatatagccttttagtagcaaagtcatacttacgtgttgtcactggattatcataaaagggagaaattaaatattactgtactcttagttgctgtgtagctaagtcaattttaagccagtaaaagcgatggatacataatgatttgatctgatctttaactattgtgaatcacagctacaccaaaactcttcttgtaagaatactgactaatatgccatgttaatctggctagattattaggactagataatgtaaaagtgatgattgtttagtaactaaattttagcaacagaaattagaattttgctttttcaaccagttaccataaagaagttagtgtatatataaacacaaataattagtgacagattcataaaaaattgaatgttgtacacagtaattttgtcagaggtagagaagacagggattgggaagtggtgggtgatggaggacctggatatatttatcaaataaagggttaccagaagtgttcattaaaggaattttagccatcatctagttcaaacctcaactattacaggtagaaaatcagggcaggagagaatataattgtgaaggagtcagggctaacacctggatctccagaaacctagcccagcaggttaatcttcacacatctctgggttctgagaaaagcctggaaaaatcacacttctttgtcattgtcatgctgaggtaataatagcaaaactgttttctttcccttaatttcctttcctaagcttatgtaatagtttggccattaaatatcttgccctattttccctattactgctagtatgctacttcttacatacccaaaagaaattcagttatttattgtatatttattgtattctaatataattgaaataaatggcatggatttattttttcttaactatttggattaaagctttgtggttcatgcaaacaatgtgcagatgatagcacctccatattactaataaaaatatgataaccatcaa

SEQ ID NO: 23357 - DNA, 3656 bp, Homo sapiens
gcctctcgcctctggacggcggcggggcggccgccggattcgcggccgcagggagcgccggagacggggagctattccgccccggcggctccattcggcgcccgcagccctcagggggtcggccccgcggcttgggagagggcaccgcggcctcggtgtgcgcagccctcgggcgcgagggtcggcggcgcggacacagccgcgttcccagccggtggggctcagcgctggcgccggcgaggactccccggccacccgcaggtaccgccgggcggagggcgcgctactagcagcgccggagatactcgagcccagggacccccgggccagcggagggcaggagcggagccccgagggagcgcgggccccgacggcgcgctcccccgtcagccacgggcaggcaggccccgcgtggcggcttggggtggggggctgcagcggggccctcgggccgaaagtcccccgggcggccagccatgaccttcgggcgcagcggggcggcctcggtggtgctgaacgtgggcggcgcccggtattcgctgtcccgggagctgctgaaggacttcccgctgcgccgcgtgagccggctgcacggctgccgctccgagcgcgacgtgctcgaggtgtgcgacgactacgaccgcgagcgcaacgagtacttcttcgaccggcactcggaggccttcggcttcatcctgctctacgtgcgcggccacggcaagctgcgcttcgcgccgcggatgtgcgagctctccttctacaacgagatgatctactggggcctggagggcgcgcacctcgagtactgctgccagcgccgcctcgacgaccgcatgtccgacacctacaccttctactcggccgacgagccgggcgtgctgggccgcgacgaggcgcgccccggcggggccgaggcggctccctccaggcgctggctggagcgcatgcggcggaccttcgaggagcccacgtcgtcgctggccgcgcagatcctggctagcgtgtcggtggtgttcgtgatcgtgtccatggtggtgctgtgcgccagcacgttgcccgactggcgcaacgcagccgccgacaaccgcagcctggatgaccggagcaggataattgaagctatctgcataggttggttcactgccgagtgcatcgtgaggttcattgtctccaaaaacaagtgtgagtttgtcaagagacccctgaacatcattgatttactggcaatcacgccgtattacatctctgtgttgatgacagtgtttacaggcgagaactctcaactccagagggctggagtcaccttgagggtacttagaatgatgaggattttttgggtgattaagcttgcccgtcacttcattggtcttcagacactcggtttgactctcaaacgttgctaccgagagatggttatgttacttgtcttcatttgtgttgccatggcaatctttagtgcactttctcagcttcttgaacatgggctggacctggaaacatccaacaaggactttaccagcattcctgctgcctgctggtgggtgattatctctatgactacagttggctatggagatatgtatcctatcacagtgcctggaagaattcttggaggagtttgtgttgtcagtggaattgttctattggcattacctatcacttttatctaccatagctttgtgcagtgttatcatgagctcaagtttagatctgctaggtatagtaggagcctctccactgaattcctgaattaatgcattgcaaatcaattcttgcatacacttcatagaaagactttgatgctgcttcatatttatgtgtttcttgctgggtgagcactgcagtggcattgtcatcatcttggtagggtaaaaattatccttcccagccgaagggataaaacagtttacttgttatggagtaaatagaattgagactgcaaaggaagaataatgactcctagagtaaactttaggacccggttttatttagacttgttttcccgtttccttgaatgattacacatttttaaaaaatacattatttgaacattttaaaacagaaaggtactattttccaaatgtttttccatcttatgaattcagaagaagcttggaacttatagtgttttttgtttgagagtaacattttcatttctaaatgttttataatttctcatatcaatgtcagaagtatcctggaaacatatgtcacatgcgggaactgtttaacaaatactttaaaaatttggccaaaatttaaactgtataatggagctagatacaagcaagaatagtatttgaaagacttttccagcatacttctcaattctttgctttatttttgtgccaattattcaccttatcgtgccgcttcatggaagcttgagtatgttctcccttttccattttggatttatctctttactgtaatgactcaaaaggtatttaagaattgacgagagcttgtgttgtttagcatcttactggataatatttgaattcattgctgttcctaggtgataactgtcctaatatttagatgtccaaacaagaatacttccaacataaaaattataataggaataatttgagatgactcaatattacaacctcttcttctcttaacctcctcccccaaacactagaggtttaataagacttatcagatgaaaggatatttatatagccttttagtagcaaagtcatacttacgtgttgtcactggattatcataaaagggagaaattaaatattactgtactcttagttgctgtgtagctaagtcaattttaagccagtaaaagcgatggatacataatgatttgatctgatctttaactattgtgaatcacagctacaccaaaactcttcttgtaagaatactgactaatatgccatgttaatctggctagattattaggactagataatgtaaaagtgatgattgtttagtaactaaattttagcaacagaaattagaattttgctttttcaaccagttaccataaagaagttagtgtatatataaacacaaataattagtgacagattcataaaaaattgaatgttgtacacagtaattttgtcagaggtagagaagacagggattgggaagtggtgggtgatggaggacctggatatatttatcaaataaagggttaccagaagtgttcattaaaggaattttagccatcatctagttcaaacctcaactattacaggtagaaaatcagggcaggagagaatataattgtgaaggagtcagggctaacacctggatctccagaaacctagcccagcaggttaatcttcacacatctctgggttctgagaaaagcctggaaaaatcacacttctttgtcattgtcatgctgaggtaataatagcaaaactgttttctttcccttaatttcctttcctaagcttatgtaatagtttggccattaaatatcttgccctattttccctattactgctagtatgctacttcttacatacccaaaagaaattcagttatttattgtatatttattgtattctaatataattgaaataaatggcatggatttattttttcttaactatttggattaaagctttgtggttcatgcaaacaatgtgcagatgatagcacctccatattactaataaaaa

SEQ ID NO: 23358 - DNA, 1636 bp, Homo sapiens
gctggaaactggctccctgagacaagaagactggtaaacccagcgcttcctacctggtggtcttcagcaatgcccatgccttccagagacgggggcctgcatcccagacaccaccactatggttcccacagcccttggagtcagctcctgtccagccccatggagacgccgtccatcaagggcctttactaccggagggtgcggaaggtgggtgccctggacgcctccccagtggacctgaagaaggagatcctgatcaacgtggggggcaggaggtatctcctcccctggagcacactggaccggttcccgctgagccgcctgagcaaactcaggctctgtcggagctacgaggagatcgtgcagctctgcgatgattacgacgaggacagccaggagttcttcttcgacaggagccccagcgccttcggggtgatcgtgagcttcctggcggccgggaagctggtgcttctgcaggagatgtgcgcgctgtccttccaggaggagctggcctactggggcatcgaggaggcccacctggagaggtgctgcctgcggaagctgctgaggaagctggaggagctggaggagctggccaagctgcacagggaggacgtactgaggcagcagagggagacccgccgccccgcctcgcactcctcgcgctggggcctgtgcatgaaccggctgcgcgagatggtggaaaacccgcagtccgggctgcccgggaaggtcttcgcttgcctctccatcctcttcgtggccaccacagccgtcagcctgtgtgtcagcaccatgcccgacctcagggcagaggaggaccagggcgaatgctctcggaagtgctactatattttcatcgtggagaccatctgcgtggcctggttctccctggagttctgcctgcggtttgtccaggcccaagacaagtgtcagttcttccaggggcccctgaacatcatcgacatcctggccatctccccatactacgtgtcgctggcggtgtctgaggagcccccggaggacggcgagaggccgagcgggagctcctacctggagaaggtggggctggtcctgcgtgtgctgcgagcgctgcgcatcctctacgtgatgcgcctggctcgccactcgctggggctgcagacgctggggctcaccgtgcgccgttgcacacgtgagttcggcctgctccttctcttcctggccgtggccatcaccctcttctcccctttggtctacgtggccgagaaggagtccgggcgggtgctggagttcaccagcatccccgcctcctattggtgggccatcatctccatgacaacggtgggctacggggacatggtgccccgcagtgtgccaggccagatggtggccctcagcagcatcctgagcgggatcctcatcatggccttcccggccacgtctatcttccacaccttctcccactcctacctggagctcaagaaggagcaggagcagcttcaggcccgcctccgccacctccaaaacaccggtccagccagtgaatgtgaactcctggacccccatgtggccagtgaacatgagctcatgaacgatgtcaatgacctaatcctggagggcccagccttgcctatcatgcacatgtaactcagca

SEQ ID NO: 23359 - DNA, 3066 bp, Homo sapiens
gcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgaggttagtgcctttatgggtgatccagggaagattggttttgctgatcagattccaccaccactggaggggagagagagtcagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaaccctgccgtcaccaccacccctaccac

SEQ ID NO: 23360 - DNA, 3102 bp, Homo sapiens
gaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaacc

SEQ ID NO: 23361 - DNA, 4286 bp, Homo sapiens
tccgcggccgggccgagccgcaggcgctgcccgagccgcgggcgctggagcggctgtcggcgcggtggcaggcgggagccaggagtccggggctcgggcgggcggagcgcagcgcggggacgcggcggagcgggccccgcggctcggcgggggccggcagacaggtgtgccggcggcgggcggctcgcgctcaggcggctccaggccgggcccggggtccggagcggggagccgggagccgagcgaggacccggcgcccgcagtccagtcttggccgcgcccgtgctcggcttggccgcggggtgcggggaccacggcccggccgggccacccgaagcctagtgctgggccgggccgggccggggtgggtgggggcccgcccggcccgcccatgggctcaggatgccggtgcggaggggccacgtcgcgccgcagaacaccttcctggacaccatcatccgcaagtttgagggccagagccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatgggagctgcttcctatgtctggtggatgtggtgcccgtgaagaacgaggatggggctgtcatcatgttcatcctcaatttcgaggtggtgatggagaaggacatggtggggtccccggctcatgacaccaaccaccggggcccccccaccagctggctggccccaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctggggaagaatgacatctttggggagcctctgaacctgtatgcaaggcctggcaagtcgaacggggatgtgcgggccctcacctactgtgacctacacaagatccatcgggacgacctgctggaggtgctggacatgtaccctgagttctccgaccacttctggtccagcctggagatcaccttcaacctgcgagataccaacatgatcccgggctcccccggcagtacggagttagagggtggcttcagtcggcaacgcaagcgcaagttgtccttccgcaggcgcacggacaaggacacggagcagccaggggaggtgtcggccttggggccgggccgggcgggggcagggccgagtagccggggccggccgggggggccgtggggggagagcccgtccagtggcccctccagccctgagagcagtgaggatgagggcccaggccgcagctccagccccctccgcctggtgcccttctccagccccaggccccccggagagccgccgggtggggagcccctgatggaggactgcgagaagagcagcgacacttgcaaccccctgtcaggcgccttctcaggagtgtccaacattttcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggctggagacccggctgagtgcagacatggccactgtcctgcagctgctacagaggcagatgacgctggtcccgcccgcctacagtgctgtgaccaccccggggcctggccccacttccacatccccgctgttgcccgtcagccccctccccaccctcaccttggactcgctttctcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctcccccagcccttgggaccatcttctcctgcagtcccctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctgaggaga

SEQ ID NO: 23362 - DNA, 3267 bp, Homo sapiens
ggggccgctggctgggcaccggcggggcgggggagcctagtgtggcggggtgggggtggggacctggtagaaggaggggccggctggaggagctgaggttccgagtgcggccgctgctgggctggcgggcgggcagagcacggcaccctggcagcagggcccacgccacggggccatgggcagctcgagccaggcaggctgctgcccacgcttactgccagggtgaccccagccctggggcccagccacaaccaccctggcttcatgccaggggctgctctggttgccagtcggccagcctcgggggtgcagcctgggctgggactgctgctggggtgcaggtgaggcagtggccgggccctcaggccccagggcaggcaggctgcagggagccaagtcctccatggcggccccagccgggaaggcgagcaggacaggggctctgcggcccagggcccagaaaggccgggtgaggcgggccgtgcgcatctccagcctcgtggcccaggaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctggggaagaatgacatctttggggagcctctgaacctgtatgcaaggcctggcaagtcgaacggggatgtgcgggccctcacctactgtgacctacacaagatccatcgggacgacctgctggaggtgctggacatgtaccctgagttctccgaccacttctggtccagcctggagatcaccttcaacctgcgagataccaacatgatcccgggctcccccggcagtacggagttagagggtggcttcagtcggcaacgcaagcgcaagttgtccttccgcaggcgcacggacaaggacacggagcagccaggggaggtgtcggccttggggccgggccgggcgggggcagggccgagtagccggggccggccgggggggccgtggggggagagcccgtccagtggcccctccagccctgagagcagtgaggatgagggcccaggccgcagctccagccccctccgcctggtgcccttctccagccccaggccccccggagagccgccgggtggggagcccctgatggaggactgcgagaagagcagcgacacttgcaaccccctgtcaggcgccttctcaggagtgtccaacattttcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggctggagacccggctgagtgcagacatggccactgtcctgcagctgctacagaggcagatgacgctggtcccgcccgcctacagtgctgtgaccaccccggggcctggccccacttccacatccccgctgttgcccgtcagccccctccccaccctcaccttggactcgctttctcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctcccccagcccttgggaccatcttctcctgcagtcccctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctgaggaga

SEQ ID NO: 23363 - DNA, 1754 bp, Homo sapiens
ggagctgaggttccgagtgcggccgctgctgggctggcgggcgggcagagcacggcaccctggcagcagggcccacgccacggggccatgggcagctcgagccaggcaggctgctgcccacgcttactgccagggtgaccccagccctggggcccagccacaaccaccctggcttcatgccaggggctgctctggttgccagtcggccagcctcgggggtgcagcctgggctgggactgctgctggggtgcaggtgaggcagtggccgggccctcaggccccagggcaggcaggctgcagggagccaagtcctccatggcggccccagccgggaaggcgagcaggacaggggctctgcggcccagggcccagaaaggccgggtgaggcgggccgtgcgcatctccagcctcgtggcccaggaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagtgctgtgaccaccccggggcctggccccacttccacatccccgctgttgcccgtcagccccctccccaccctcaccttggactcgctttctcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctccc

SEQ ID NO: 23364 - DNA, 4717 bp, Homo sapiens
ggggcggggggcggtggggcagcagggggcccatgtgctcaacagggagctgagggagaccaggggtgcttggcttaggggactgacctcatctggtacagggcctttggtggacagagagagactggaaaagaaaaagtcaaggatcgaggggaacgcgaggcgaggtgaagatgaaagatctagaagcagtgcttcttagactctttggtgaaggatcagtgttttttaatgctaatatgttataggctggtacatctgtgaaatacaagagcacatgcgtggattttgtggtgatgccaaattgctgtaaagtttttgaaattcttgctctcaacgtctgtccttatcttgtgtgctgacacaacggctggtgctaatctagagagaacagagagacagatagtaacagctaaccgtctgtagtgtgcggcatacgccaggcattgcctaagcgctcagcatgtgctgacttggttaatctttataactcatgagaaaagaattatatacattatgtgtatcacaacatcactgtgtaccccataaatatgtacaattattgtgtcaattaaaaagttaaaaaattttaaaaagaaaaaattattattcttcccattttatagatggaaaaaatgaggcacaaggatgttaaataatttaggaaaaaagcataagtgattaagcagcagatccgggctatgaacccagagatcgtaggcctaaagtctgtgggcttaagcactgtgctacagcgcctcgcttgagggaaaggcagaggtgctgggaggatatgaggaaatgagatagggaggaaatgagatcaaagatggcagaagaaaggatcatagccagcgtgagaaaaagtgcagccgggaaagagctagataaatcatataggcagagagaggggtaggggagcctggcagcaacaagctggggtagacagattgaggggagccataagggcggcaggcacatggccgggtgggggatcaggacgggagatcccggagaggaagggccatacggggaggcagaagtggacgggcccacttgggttccagggtccatcctgcgtggctttctgctctgcccactgagtgggtgccaagggggctatgtcctcccactctgcagggagctgcttcctatgtctggtggatgtggtgcccgtgaagaacgaggatggggctgtcatcatgttcatcctcaatttcgaggtggtgatggagaaggacatggtggggtccccggctcatgacaccaaccaccggggcccccccaccagctggctggccccaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctggggaagaatgacatctttggggagcctctgaacctgtatgcaaggcctggcaagtcgaacggggatgtgcgggccctcacctactgtgacctacacaagatccatcgggacgacctgctggaggtgctggacatgtaccctgagttctccgaccacttctggtccagcctggagatcaccttcaacctgcgagataccaacatgatcccgggctcccccggcagtacggagttagagggtggcttcagtcggcaacgcaagcgcaagttgtccttccgcaggcgcacggacaaggacacggagcagccaggggaggtgtcggccttggggccgggccgggcgggggcagggccgagtagccggggccggccgggggggccgtggggggagagcccgtccagtggcccctccagccctgagagcagtgaggatgagggcccaggccgcagctccagccccctccgcctggtgcccttctccagccccaggccccccggagagccgccgggtggggagcccctgatggaggactgcgagaagagcagcgacacttgcaaccccctgtcaggcgccttctcaggagtgtccaacattttcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggctggagacccggctgagtgcagacatggccactgtcctgcagctgctacagaggcagatgacgctggtcccgcccgcctacagtgctgtgaccaccccggggcctggccccacttccacatccccgctgttgcccgtcagccccctccccaccctcaccttggactcgctttctcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctcccccagcccttgggaccatcttctcctgcagtcccctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctgaggaga

SEQ ID NO: 23365 - DNA, 3145 bp, Homo sapiens
ccatgggctcaggatgccggtgcggaggggccacgtcgcgccgcagaacaccttcctggacaccatcatccgcaagtttgagggccagagccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatgggagctgcttcctatgtctggtggatgtggtgcccgtgaagaacgaggatggggctgtcatcatgttcatcctcaatttcgaggtggtgatggagaaggacatggtggggtccccggctcatgacaccaaccaccggggcccccccaccagctggctggccccaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctgggtatggggtggggggcgggcactggactggaaatgccctctgcagcctcaagaggtgcgagccttctgaatatgcagtcactggggctgtggacctgggactgcctgcagggtcactgggctcctttaattcacctaaactcaggccctccaagcggggccatggagaggagccccacgtggggtgaggctgctgaactctggggttcccacattctccttcccttcaggatccgccacaaacagacactttttgcttccttaaagtaggatcaaatctagatcctctagcctgggcagtagaggaagaaatgctagcctggaagctcggcatttggtttcactaagggccatgtggttccctgcagcctcatgcctggccccttgacacatccaaagcaaagggagtcctgccccctccccccacttcctttctaccctgcctgtgcacagtgggtgggttggtgtgtctggacactgaggacttcctccccctttgcctgtccttccctcggccctgtgtgcctcagggcagatatagcaagctctttcgaccatagttgatggtaggacattttagactttgtttctcagctctgtacaaacacaaatacacacccccacaaaactaaaatcaaagtttcactacataacactgggccttactgcatgtggttcattctagcatttctgttctgtgctgtgctaagctatactactgtatgttctttcagt

SEQ ID NO: 23366 - DNA, 3853 bp, Homo sapiens
ggccgcggggcctggagcccgggatttgtgggcggcgagggcgcgaggggccgcgcgccatgctccgggccccgacggcgcggacgccccctcgcgcgccagcgtccggcgcgaccccggatcccggtctgcgcattgccccccgacggctgcgctagggagcgcggggcccggcggggggcggccgagctgggcgccctcccccggcgcggagtccccgcaccccggagggatggggcgggcagccgcgggcgcctaagatgccggccatgcggggcctcctggcgccgcagaacaccttcctggacaccatcgctacgcgcttcgacggcacgcacagtaacttcgtgctgggcaacgcccaggtggcggggctcttccccgtggtctactgctctgatggcttctgtgacctcacgggcttctcccgggctgaggtcatgcagcggggctgtgcctgctccttcctttatgggccagacaccagtgagctcgtccgccaacagatccgcaaggccctggacgagcacaaggagttcaaggctgagctgatcctgtaccggaagagcgggctcccgttctggtgtctcctggatgtgatacccataaagaatgagaaaggggaggtggctctcttcctagtctctcacaaggacatcagcgaaaccaagaaccgagggggccccgacagatggaaggagacaggtggtggccggcgccgatatggccgggcacgatccaaaggcttcaatgccaaccggcggcggagccgggccgtgctctaccacctgtccgggcacctgcagaagcagcccaagggcaagcacaagctcaataagggggtgtttggggagaaaccaaacttgcctgagtacaaagtagccgccatccggaagtcgcccttcatcctgttgcactgtggggcactgagagccacctgggatggcttcatcctgctcgccacactctatgtggctgtcactgtgccctacagcgtgtgtgtgagcacagcacgggagcccagtgccgcccgcggcccgcccagcgtctgtgacctggccgtggaggtcctcttcatccttgacattgtgctgaatttccgtaccacattcgtgtccaagtcgggccaggtggtgtttgccccaaagtccatttgcctccactacgtcaccacctggttcctgctggatgtcatcgcagcgctgccctttgacctgctacatgccttcaaggtcaacgtgtacttcggggcccatctgctgaagacggtgcgcctgctgcgcctgctgcgcctgcttccgcggctggaccggtactcgcagtacagcgccgtggtgctgacactgctcatggccgtgttcgccctgctcgcgcactgggtcgcctgcgtctggttttacattggccagcgggagatcgagagcagcgaatccgagctgcctgagattggctggctgcaggagctggcccgccgactggagactccctactacctggtgggccggaggccagctggagggaacagctccggccagagtgacaactgcagcagcagcagcgaggccaacgggacggggctggagctgctgggcggcccgtcgctgcgcagcgcctacatcacctccctctacttcgcactcagcagcctcaccagcgtgggcttcggcaacgtgtccgccaacacggacaccgagaagatcttctccatctgcaccatgctcatcggcgccctgatgcacgcggtggtgtttgggaacgtgacggccatcatccagcgcatgtacgcccgccgctttctgtaccacagccgcacgcgcgacctgcgcgactacatccgcatccaccgtatccccaagcccctcaagcagcgcatgctggagtacttccaggccacctgggcggtgaacaatggcatcgacaccaccgagctgctgcagagcctccctgacgagctgcgcgcagacatcgccatgcacctgcacaaggaggtcctgcagctgccactgtttgaggcggccagccgcggctgcctgcgggcactgtctctggccctgcggcccgccttctgcacgccgggcgagtacctcatccaccaaggcgatgccctgcaggccctctactttgtctgctctggctccatggaggtgctcaagggtggcaccgtgctcgccatcctagggaagggcgacctgatcggctgtgagctgccccggcgggagcaggtggtaaaggccaatgccgacgtgaaggggctgacgtactgcgtcctgcagtgtctgcagctggctggcctgcacgacagccttgcgctgtaccccgagtttgccccgcgcttcagtcgtggcctccgaggggagctcagctacaacctgggtgctgggggaggctctgcagaggtggacaccagctccctgagcggcgacaatacccttatgtccacgctggaggagaaggagacagatggggagcagggccccacggtctccccagccccagctgatgagccctccagccccctgctgtcccctggctgcacctcctcatcctcagctgccaagctgctatccccacgtcgaacagcaccccggcctcgtctaggtggcagagggaggccaggcagggcaggggctttgaaggctgaggctggcccctctgctcccccacgggccctagaggggctacggctgccccccatgccatggaatgtgcccccagatctgagccccagggtagtagatggcattgaagacggctgtggctcggaccagcccaagttctctttccgcgtgggccagtctggcccggaatgtagcagcagcccctcccctggaccagagagcggcctgctcactgttccccatgggcccagcgaggcaaggaacacagacacactggacaagcttcggcaggcggtgacagagctgtcagagcaggtgctgcagatgcgggaaggactgcagtcacttcgccaggctgtgcagcttgtcctggcgccccacagggagggtccgtgccctcgggcatcgggagaggggccgtgcccagccagcacctccgggcttctgcagcctctgtgtgtggacactggggcatcctcctactgcctgcagcccccagctggctctgtcttgagtgggacttggccccaccctcgtccggggcctcctcccctcatggcaccctggccctggggtcccccagcgtctcagagctccccctggcctcgagccacagctttctggacctccacctcagactcagagccccctgcctcaggagacctctgctctgagcccagcacccctgcctcccctcctccttctgaggaaggggctaggactgggcccgcagagcctgtgagccaggctgaggctaccagcactggagagcccccaccagggtcagggggcctggccttgccctgggacccccacagcctggagatggtgcttattggctgccatggctctggcacagtccagtggacccaggaagaaggcacaggggtctgagtaccagccctagaactcagcgttgccaggtgtgctgccatctgctgttcggcccaacctcagagtgaaggcagggtggcagcctccccacggactccatgcggcccgctggctcagggcagggagcctggaagcaaaggaggacctggctcctgactctcagagaggataggctggatccctggggcaggcctctcctcggcctgctcctctgacctcccggtctccctctgcaggctgggggcagaggcctgaggacaaggaagagctttgccatcccctgcatgtgcccctgcctctacctgtccccaaatttttatattaaaaaaaaaaaataaaat

SEQ ID NO: 23367 - DNA, 4175 bp, Homo sapiens
gttcccgagccccgtgtgcggcaccgccacagtctgggcagcggcggccgggggagcgctactaccatgaactgcctggtcctcctccccagagctgctcatccgggtcgggctggagacacagtcaggggaccccgtcgccgccgccgcgccccctcttctttcggctcaatcttctcttccaccttttcctcctcttcctccaccttctttgcctgcatccccccctcccccgccgcggatcctggccgctgctctccagacccaggatgccggggggcaagagagggctggtggcaccgcagaacacatttttggagaacatcgtcaggcgctccagtgaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctctcttctttatgcaactatttttggaaatgttacaacaattttccagcaaatgtatgccaacaccaaccgataccatgagatgctgaataatgtacgggacttcctaaaactctatcaggtcccaaaaggccttagtgagcgagtcatggattatattgtctcaacatggtccatgtcaaaaggcattgatacagaaaaggtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagggaagggtgatgtatttggagacatcttctggaaggaaaccacccttgcccatgcatgtgcgaacgtccgggcactgacgtactgtgacctacacatcatcaagcgggaagccttgctcaaagtcctggacttttatacagcttttgcaaactccttctcaaggaatctcactcttacttgcaatctgaggaaacggatcatctttcgtaagatcagtgatgtgaagaaagaggaggaggagcgcctccggcagaagaatgaggtgaccctcagcattcccgtggaccacccagtcagaaagctcttccagaagttcaagcagcagaaggagctgcggaatcagggctcaacacagggtgaccctgagaggaaccaactccaggtagagagccgctccttacagaatggagcctccatcaccggaaccagcgtggtgactgtgtcacagattactcccattcagacgtctctggcctatgtgaaaaccagtgaatcccttaagcagaacaaccgtgatgccatggaactcaagcccaacggcggtgctgaccaaaaatgtctcaaagtcaacagcccaataagaatgaagaatggaaatggaaaagggtggctgcgactcaagaataatatgggagcccatgaggagaaaaaggaagactggaataatgtcactaaagctgagtcaatggggctattgtctgaggaccccaagagcagtgattcagagaacagtgtgaccaaaaacccactaagaaaaacagattcttgtgacagtggaattacaaaaagtgaccttcgtttggataaggctggggaggcccgaagtccgctagagcacagtcccatccaggctgatgccaagcaccccttttatcccatccccgagcaggccttacagaccacactgcaggaagtcaaacacgaactcaaagaggacatccagctgctcagctgcagaatgactgccctagaaaagcaggtggcagaaattttaaaaatactgtcggaaaaaagcgtaccccaggcctcatctcccaaatcccaaatgccactccaagtacccccccagataccatgtcaggatatttttagtgtctcaaggcctgaatcacctgaatctgacaaagatgaaatccacttttaatatatatacatatatatttgttaatatattaaaacagtatatacatatgtgtgtatatacagtatatacatatatatattttcacttgctttcaagatgatgaccacacatggattttgatatgtaaatattgcatgtccagctggattctggcctgccaaagaagatgatgattaaaaacatagatattgcttgtatattatgcagttgactgcatgcacactttacatttatttataatctctattctataataaaagagtatgatttttgttacccaaggcaatgtaatatttgaagaatcagggtccaacctgccaatgttgccatgacaaatttgatctcaggctgagtatgtatatcgagctatcattttctcactgttctgttaagttaaaagtatagattaatgccaaggaagagttcagtcttttaaactattagtaccatgttatgatctctttccataggatatttttctgtaacttagtgttaggttcttttcccctacaggcagtgtttgctccatttaaatgactgtttagttgcctaagtcagataagagtgtgggatattgaaaacttattgctatgggttttgtgcatgaattacatttttgatcaactatacctctcgttttttaacattatacttagatagtaatcattagctcttatgtaaggaaatccctactccctccttcttggagaacagctgccatcttgtaagctgacattatcaacatcataaatactaaactattaatatagagtatgttattatagaaacactgcaccacagggtataagggccttttgacaattcatgtaagagatgctgaatttccaaagctgataaatgctctaaatttgtatttccaaaacatgttcaagagtgacattgaaaggcttgttagcaaagaaacatacaaaaaataaa

SEQ ID NO: 23368 - DNA, 1849 bp, Homo sapiens
acgtcacgctatttttttttttttttttttttgtatttttagtagagacggagtttcacgtgttagccaggatggtctggatcttctgaccttgtgatctgcccgcctcggcctcccaaagtgctgggattacaggcgtgagccaccgcgcccggccgaagactgaatttttgagcaaatgaaagacaccaacaaaatccaacacataaagattcacacttgaaacagattaatcaggaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctgtaagtattttaattttttcattgaaaattattgttattggcaattttcctggctacaatctcagataggatgaaaacgaactactttgtttacagaaaggtatttaatccatcttatttgcaattgttttttttaatctaccttagaaaatagaaatgcaaaataatatattttactcttcaggacataataatgtgtgaaaaacatattaatgtgtgtacccagcagtgctctcttgaaggaaccaggaccagcatccagagaggtggcgtttcgcacattccatagattttgttggtaatgtgttaaattcc

SEQ ID NO: 23369 - DNA, 2434 bp, Homo sapiens
ggccccctccggaaggtgaggggaatggattggactccggtggggaaagcgggtgtctagaagtggtgctaatgggaagagaattctggtttcaaaagaggatgctctgccacaaagagcggctcgcgcgctggcctgggctctagccgaggagagatcccgggagaactccagagctccgggggagcgctcctcggaagaccggggccaacatgcctgtgcgcagggggcatgtggcaccacaaaatacatttctggggaccatcattcggaaatttgaagggcaaaataaaaaatttatcattgcaaatgccagagtgcagaactgtgccatcatttattgcaacgatgggttctgtgagatgactggtttctccaggccagatgtcatgcaaaagccatgcacctgcgactttctccatggacccgagaccaagaggcatgatattgcccaaattgcccaggcattgctggggtcagaagagaggaaagtggaggtcacctactatcacaaaaatgggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaaaagacgagaatgtggctattcttgtagccctttgaatgtggtagacttgattgtggatattatgtttatcatagatattttaataaacttcagaacaacatatgtaaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctcttaatgtgcatctttgccctgattgctcactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtatgtatgtctgttttccaaaatgaaagtgccgcaggcattatagtgatagccaaaatggaataaaagccggaatcaccagctttgaa

SEQ ID NO: 23370 - DNA, 4113 bp, Homo sapiens
caaagagcggctcgcgcgctggcctgggctctagccgaggagagatcccgggagaactccagagctccgggggagcgctcctcggaagaccggggccaacatgcctgtgcgcagggggcatgtggcaccacaaaatacatttctggggaccatcattcggaaatttgaagggcaaaataaaaaatttatcattgcaaatgccagagtgcagaactgtgccatcatttattgcaacgatgggttctgtgagatgactggtttctccaggccagatgtcatgcaaaagccatgcacctgcgactttctccatggacccgagaccaagaggcatgatattgcccaaattgcccaggcattgctggggtcagaagagaggaaagtggaggtcacctactatcacaaaaatgggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagacaatggtcgcaatgtcaaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaaaagacgagaatgtggctattcttgtagccctttgaatgtggtagacttgattgtggatattatgtttatcatagatattttaataaacttcagaacaacatatgtaaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctcttaatgtgcatctttgccctgattgctcactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtcctaaagggtttcccagaatgcttacaagcagacatttgtctacatctcaaccagacattgctgcaaaactgcaaagcctttcggggggcaagtaaaggttgccttagagctttggcaatgaagttcaaaaccacccatgcacctccaggagacaccctcgttcactgtggggatgtcctcactgcactttatttcttatccagaggctccattgaaattctcaaagatgacattgtggtggctattctgggaaaaaatgatatatttggagaaatggttcatctttatgccaaacctggaaagtctaatgcagatgtaagagccctcacatactgtgacttgcataagattcagcgagaagacttgttagaggttttggatatgtatcctgagttttctgatcactttctaacaaacctagagttgactttcaacctaaggcatgagagcgcaaaggctgatctcctacgatcacaatccatgaatgattcagaaggagacaactgtaaactaagaagaaggaaattgtcatttgaaagtgaaggagagaaagaaaacagtacaaatgatcctgaagactctgcagataccataagacattatcagagttccaagagacactttgaagagaaaaaaagcagatcctcatctttcatctcctccattgatgatgaacaaaagccgctcttctcaggaatagtagactcttctccaggaatagggaaagcatctgggctcgattttgaagaaacagtgcccacctcaggaagaatgcacatagataaaagaagtcactcttgcaaagatatcactgacatgcgaagctgggaacgagaaaatgcacatccccagcctgaagactccagtccatctgcacttcagcgagctgcctggggtatctctgaaaccgaaagcgacctcacctacggggaagtggaacaaagattagatctgctccaggagcaacttaacaggcttgaatcccaaatgaccactgacatccagaccatcttacagttgctgcagaaacaaaccactgtggtccccccagcctacagtatggtaacagcaggatcagaatatcagagacccatcatccagctgatgagaaccagtcaaccggaagcatccatcaaaactgaccgaagtttcagcccttcctcacaatgtcctgaatttctagaccttgaaaaatctaaacttaaatccaaagaatccctttcaagtggggtgcatctgaacacagcttcagaagacaacttgacttcacttttaaaacaagacagtgatctctctttagagcttcacctgcggcaaagaaaaacttacgttcatccaattaggcatccttctttgccagattcatccctaagcactgtaggaatcgtgggtcttcataggcatgtttctgatcctggtcttccagggaaataatcattttgtactatttactccacatacaatgtaagtgcttttaatggctgttttcctttttctatttaaatcctctctacttgactcaggggctcacaaggtaccattatatgcaaaagtactgtatattttcctaaattgaagcttgtaaggtaaaactgagcagttaggatgtaaatatacataagaacttttggttccaaatgttaaaactgccagcatctcacggcaccttattttttatttttattttttaaatcacatgcatgttaggaaactccaatttctcttgcatggagactcctatttactgcttttactaaaccagtacttcgttatgaaaatgccttccacgcaaataagaaaccaagggataaaactgttcatggatgcaactcaaattcagatgatcctcaactcat

SEQ ID NO: 23371 - DNA, 1826 bp, Homo sapiens
ggtagacgcgatctgttcgctactaccggcctcccctggctgttaaaagcagatggtggctgaggtttgttcaatgcccactgcctctactgtgaagaagccatttgatctcaggagcaagatgggcaagtggtgccaccaccgcttcccctgctgcagggggagcggcaagagcaacatgggcacttctggagaccacgacgactcctttatgaagatgctcaggagcaagatgggcaagtgttgccgccactgcttcccctgctgcagggggagcggcacgagcaacgtgggcacttctggagaccatgaaaactcctttatgaagatgctcaggagcaagatgggcaagtggtgctgtcactgcttcccctgctgcagggggagcggcaagagcaacgtgggcgcttggggagactacgaccacagcgccttcatggagccgaggtaccacatccgtcgagaagatctggacaagctccacagagctgcctggtggggtaaagtccccagaaaggatctcatcgtcatgctcagggacactgacatgaacaagagggacaaggaaaagaggactgctctacatttggcctctgccaatggaaattcagaagtagtacaactcctgctggacagacgatgtcaacttaatgtccttgacaacaaaaaaaggacagctctgataaaggccatacaatgccaggaagatgaatgtgtgttaatgttgctggaacatggcgctgatcgaaatattccagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgtacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaacaagacttaaagctgacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaggagcagaaaacctgaaaatcagcaatttcctgacactgagaatgaagagtatcacagtgatgaacaaaatgatacccggaaacaactttctgaagaacagaacactggaatatcacaagatgagattctgactaataaacaaaagcagatagaagtggctgaacagaaaatgaattctgagctttctcttagtcataagaaagaagaagatctcttgcgtgaaaacagcgtgttgcaggaagaaattgccatgctaagactggaactagatgaaacaaaacatcagaaccagctaagggaaaataaaattttggaggaaattgaaagtgtgaaagaaaagactgataaacttctaagggctatgcaattgaatgaagaagcattaacgaaaaccaatatttaagtacagtggacagcttagg

SEQ ID NO: 23372 - DNA, 1928 bp, Homo sapiens
ggtagacgcgatctgctggctactaccggccttccctggctgttaaaagcagatggtggctgaggctggttcaatgccggctgcctcctctgtgaagaagccatttggtctcagaagcaagatgggcaagtggtgccgccactgcttcgcctggtgcagggggagcggcaagagcaacgtgggcacttctggagaccacgacgattctgctatgaagacactcaggagcaagatgggcaagtggtgctgccactgcttcccctggtgcagggggagcggcaagagcaacgtgggcacttctggagaccacgacgattctgctatgaagacactcaggagcaagatgggcaagtggtgctgccactgcttcccctgctgcagggggagcggcaagagcaacgtgggcacttctggagaccacgacgactctgctatgaagacactcaggagcaagatgggcaagtggtgctgccactgcttcccctgctgcagggggagcggcaagaacaaagtgggcccttggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgactaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaac

SEQ ID NO: 23373 - DNA, 2124 bp, Homo sapiens
ggtagacgcgatctgctggctactaccggccttccctggctgttaaaagcagatggtggctgaggctggttcaatgccggctgcctcctctgtgaagaagccatttggtctcagaagcaagatgggcaagtggtgccgccactgcttcgcctggtgcagggggagcggcaagagcaacgtgggcacttctggagaccacgacgattctgctatgaagacactcaggagcaagatgggcaagtggtgctgccactgcttcccctggtgcagggggagcggcaagagcaacgtgggcacttctggagaccacgacgattctgctatgaagacactcaggagcaagatgggcaagtggtgctgccactgcttcccctgctgcagggggagcggcaagagcaacgtgggcacttctggagaccacgacgactctgctatgaagacactcaggagcaagatgggcaagtggtgctgccactgcttcccctgctgcagggggagcggcaagaacaaagtgggcccttggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagattgagtctcactctgtttcccaggctggagtgcagtggtgtgatcacagctcactgcaacctcgacctcccgaagctcagatggtcctccaacctcaacctcagttgtttttttctttctttctttttatttttatttttatttttatttttttttagtagagatttggtttttgccatgtttctcaggctggtcttgaactcctgggctcaagcaattcatccccctcagcctcccaaagtgctaggattacaggtcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgactaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgac

SEQ ID NO: 23374 - DNA, 1926 bp, Homo sapiens
ggtagacgcgatctgctggctactaccggccttccctggctgttaaaagcagatggtggctgaggctggttcaatgccggctgcctcctctgtgaagaagccatttggtctcagaagcaagatgggcaagtggtgccgccactgcttcgcctggtgcagggggagcggcaagagcaacgtgggcacttctggagaccacgacgattctgctatgaagacactcaggagcaagatgggcaagtggtgctgccactgcttcccctggtgcagggggagcggcaagagcaacgtgggcacttctggagaccacgacgactctgctatgaagacactcaggagcaagatgggcaagtggtgctgccactgcttcccctgctgcagggggagcggcaagaacaaagtgggcccttggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgactaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaacggctctggcatgtgcaaggccggctttgcaggtgacgatgccccccgggctgtcttcccttccatcgtggggtgccccaggcaccagaacatgatggggggcatgcgtc

SEQ ID NO: 23375 - DNA, 1149 bp, Homo sapiens
ggggagcagcggttctccttatttttctactctcttgtgggaatgagttgccaagcttttacttcggctgatacctttatacctctgaattctgacgcctctgcaactctgcctctgataatgcatcacagtgctgccgagtgtctaccagtctccaaccatgccaccaatgtgatgtctacagtcccatctattttgtctttgatccaaactcctaaatgtttgtgcacacatttctcggtgacaacgttgggaaacacagcaacaggacttcattattctgttccttcctgtcattatggaaaccagccatcaacctatggagtgatggcaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggagctttgtacaatgaaaaagtgggagcaaatgaaaggaaaagaaaacgaagaacaactataagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagataagatttttctattgtataatagcctttttctcccgtttcattcctttctcttcctcaacaaaaacagaaattacttggttgacttaaaatcattttatatcaatagcttttacagaagctttacttttccacttttttttaaaaaaaagaaacc

SEQ ID NO: 23376 - DNA, 1491 bp, Homo sapiens
ctcagagccttcctgatgtatatatgcaggtagtgagaattgaatcggccctttgagacagtaatataataaaactctgatttggggagcagcggttctccttatttttctactctcttgtgggaatgagttgccaagcttttacttcggctgatacctttatacctctgaattctgacgcctctgcaactctgcctctgataatgcatcacagtgctgccgagtgtctaccagtctccaaccatgccaccaatgtgatgtctacagcaacaggacttcattattctgttccttcctgtcattatggaaaccagccatcaacctatggagtgatggcaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggagctttgtacaatgaaaaagtgggagcaaatgaaaggaaaagaaaacgaagaacaactataagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagataagatttttctattgtataatagcctttttctcccgtttcattcctttctcttcctcaacaaaaacagaaattacttggttgacttaaaatcattttatatcaatagcttttacagaagctttacttttccacttttttttaaaaaaaagaaaccaacaatttaaattatattgatgttatttacttaaaataattattctcagaagccacattgtctattttaagccaaatatattaacagtaataaaatgatctctctgtctctcccgctctctttctcacacacacgcagacatatgagtatgggtttataagttccttttccaaacatgtatattagctttttaacatgtaagtcagtaatgacacatatgtaaagcacatcaccagaaatatccaattcaaaaattaaccaatgttctgctttctaccaactctactaatttgtctgaactaaaagttttgaacttaagagctggaggtgtcttata

SEQ ID NO: 23377 - DNA, 3295 bp, Homo sapiens
gcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggctgtggctgcccgcgctgcgctgttgctctgtcccagctggctagctccgagtgtggagcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttgacctatgcctctccgccactcatcaccaatgtcacgacaagaagctccgccacgcccgcagtggggcccccgctggagggcccagagcaccaggcacccctcacctatttcccgtggcctcagcccctttccacactacccacctccaccctgcagtaccagcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactacactttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctgtctcacctctaggccctctgctggtgctgtggaggccaagaccccattaagcctaaaggtgatgggtcctcgcctaggcttagtgctaccatgtgggttttgtttctttccttccttccttccttccttccttccttccttccttccttccttccttccttccttccttctttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgaccttgtgatccgcccgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaagtt

SEQ ID NO: 23378 - DNA, 4536 bp, Homo sapiens
ggctcggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagacc

SEQ ID NO: 23379 - DNA, 4610 bp, Homo sapiens
ggctcggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggaagcacaatggtggggttgagctccgggctgagtccagccctcatgagcaacaaccctttggccactatccaagccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagacc

SEQ ID NO: 23380 - DNA, 4513 bp, Homo sapiens
ggctcggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaaaaaaaaaaaaaaaaaa

SEQ ID NO: 23381 - DNA, 1928 bp, Homo sapiens
tggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaacc

SEQ ID NO: 23382 - DNA, 1776 bp, Homo sapiens
gagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaa

SEQ ID NO: 23383 - DNA, 1703 bp, Homo sapiens
ggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacggggtaagtgggtgcacgtgggaagctgtggggagaagcagggtcgctgctgcttctagggtggggagcggcaccccagttatgttggcaggtccctgcccctgctaatgcctctgctttgcctcttgcagaagcacaatggtggggttgagctccgggctgagtccagccctcatgagcaacaaccctttggccactatccaaggtgcgtgctgcctcatgtcacacccatcgtcaccagccc

SEQ ID NO: 23384 - DNA, 2053 bp, Homo sapiens
ctcggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggaagcacaatggtggggttgagctccgggctgagtccagccctcatgagcaacaaccctttggccactatccaagccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaa

SEQ ID NO: 23385 - DNA, 3013 bp, Homo sapiens
gcgacagtggcggcgacggctccggcagcggctcccgcggcggcggcggccgggaactggaggaaggagaccctggcttcgcaggggccccggctggggcagaggcgaggggcctgggggggcgctggctttggccccgcctggggcaggatggtgaatctggagtccatgcacacagatatcaagatgagtggggatgtagccgattccacggatgctcgcagcactctcagccaggtggagccaggaaatgatcgaaatggcctagatttcaacaggcagattaaaaccgaagatctcagtgactccctgcagcagaccctctcccatcggccatgccacctgagtcaaggacctgccatgatgtccggaaaccaaatgtctgggctaaatgccagcccatgtcaggacatggcttccctccatccgctccagcagcttgtgctggttcccggccacttacagtctgtatcccagttcctgctatctcagacccagcctgggcagcaaggtctgcagccaaatctcctcccctttccacagcaacaaagcggtctcctcctcccacagactgggccgggactggcatcccaggcatttgggcaccctgggctgccaggatcctctttagaaccccacctggaagcatcccagcatctcccagtgcccaagcatctacccagctctggaggggccgatgagcccagtgacctcgaggagctggagaagtttgccaagaccttcaagcagaggcgcattaagctgggcttcacacagggagatgtggggctggcgatgggaaagctgtatggcaacgacttcagccagaccaccatctcacgatttgaggccctcaacctgagcttcaagaacatgtgcaagctcaagcccctgctggagaagtggctgaatgatgcagagtcctctccgtcagacccctcagtgagcacgcccagctcctaccccagcctcagtgaagtatttggtaggaagagaaagaaacggaccagcatcgagaccaacatccgcctgactctggagaagaggtttcaagataacccaaaacccagctcggaggagatctccatgattgcagagcagttgtccatggagaaggaggtggtgagggtctggttctgcaaccgacgccaaaaggagaagcgaatcaactgccctgtggccacacccatcaaaccacctgtctacaactcccggctggtatctccctcagggtctctgggccccctctctgtccctcctgtccacagtaccatgcctggaacagtaacgtcatcctgttcccctgggaacaacagcaggccttcatctcctggctcaggactccacgccagcagccccactgcatctcaaaataactccaaagcagcagtgaactccgcctccagttttaactcttcaggatcttggtaccgatggaatcattccacctacctccactgagaccaaaaagtttctcctactccagctggccctgtattccccctggaaggaagggaatcatgccttctatatacagacagattgccttcagaagagtggaagaaaatctccactatcaatgaacccagactcttgtcttcttcaagagcaagggcctccggagatccaaactgtgattgaaccaagtgcagactcctaatgctcttgaaatacacagcccctcctaggagcttaccattttcaccttccttgcctatgcccttgccttctagttccaaatattttagccagcttcactgtggcaatagtctttcagagaaaagacttcttgctgttattctccaactcatccgtgggcttctggggacagccatttggctggggtgccaaacaccagaaggggagataatagttttgactctgaacttggccacaacccctgaactgatcccaaaatctgtgaaaagatttgaatctgatatctccaccaaagccttgatgttttctctgtacagctaagttttctgatggaatcttcatctcaccccattttctttttaacctcgcccccttttctacaatcaaatccattcattattgcgccctccaggtcccctcctttttgcagaaggtgtaaaagagctgcccttggtgggtgccctgggcatgttgcaacgcctgctggtgcccttctgtctgtccacgtctgcctagggctcaggagtgcttgttctttcccttcctccctgtgtttctctttatcctgtcccctctcctttctcctggcagcagaaaaggaagaacacaagagcaaacacacaacaatgatggtggcaaagtacctgtatatagccctttcccattttttgcattatgttcttaactccttaatgtggaattttccagcaaaatgtttaactcaggtgtgatttttgaaaatgtctctgtaatattttatcttctttaaaaaaaagggggggaaataccaaagtgtgaaatactgtgctaccttccagagttcccacatgggctgggatttttttttctttttcttttttttttttttttttgagacagtcttgctccagcccaggctggagtgcagtggcatgatcttggctcactgcatgctctgccacttgggttcaagcgattctcctgcctcagcctctcaagtagcgggattacaggcgcccaccaccaaaaattagcccagctaatttttgtatttttagtagagatggggtttcaccatgttggtcaggctggtcttgaactcctgacctcctgatccacccacctcagcgtcccgaagtgctgggattacaggtgtgagccaccgcgcctggcctgggctgggaatctttgttgacttctttgggaacattatctctagagtctgcttttttgtgggccagtttgtagagatgtaacatgaagccattccagaaatggtaacttaaaaaaaaaaagactacatgtctaggaaactgttgagattcaaaggaatctcactgttcctaaataaatgtgtatagtgattatgaaaagt

SEQ ID NO: 23386 - DNA, 1662 bp, Homo sapiens
ctcactccagcccagagctcaaaaaaccggtttcatggagtctccaagaactgctaaaggaggaagggatatcaagatgagtggggatgtagccgattccacggatgctcgcagcactctcagccaggtggagccaggaaatgatcgaaatggcctagatttcaacaggcagattaaaaccgaagatctcagtgactccctgcagcagaccctctcccatcggccatgccacctgagtcaaggacctgccatgatgtccggaaaccaaatgtctgggctaaatgccagcccatgtcaggacatggcttccctccatccgctccagcagcttgtgctggttcccggccacttacagtctgtatcccagttcctgctatctcagacccagcctgggcagcaaggtctgcagccaaatctcctcccctttccacagcaacaaagcggtctcctcctcccacagactgggccgggactggcatcccaggcatttgggcaccctgggctgccaggatcctctttagaaccccacctggaagcatcccagcatctcccagtgcccaagcatctacccagctctggaggggccgatgagcccagtgacctcgaggagctggagaagtttgccaagaccttcaagcagaggcgcattaagctgggcttcacacagggagatgtggggctggcgatgggaaagctgtatggcaacgacttcagccagaccaccatctcacgatttgaggccctcaacctgagcttcaagaacatgtgcaagctcaagcccctgctggagaagtggctgaatgatgcagagtcctctccgtcagacccctcagtgagcacgcccagctcctaccccagcctcagtgaagtatttggtaggaagagaaagaaacggaccagcatcgagaccaacatccgcctgactctggagaagaggtttcaagataacccaaaacccagctcggaggagatctccatgattgcagagcagttgtccatggagaaggaggtggtgagggtctggttctgcaaccgacgccaaaaggagaagcgaatcaactgccctgtggccacacccatcaaaccacctgtctacaactcccggctggtatctccctcagggtctctgggccccctctctgtccctcctgtccacagtaccatgcctggaacagtaacgtcatcctgttcccctgggaacaacagcaggccttcatctcctggctcaggactccacgccagcagccccactgcatctcaaaataactccaaagcagcagtgaactccgcctccagttttaactcttcaggatcttggtaccgatggaatcattccacctacctccactgagaccaaaaagtttctcctactccagctggccctgtattccccctggaaggaagggaatcatgccttctatatacagacagattgccttcagaagagtggaagaaaatctccactatcaatgaacccagactcttgtcttcttcaagagcaagggcctccggagatccaaactgtgattgaaccaagtgcagactcctaatgctcttgaaatacacagcccctcctaggagcttaccattttcaccttccttgcctatgcccttgccttctagttccaaatattttagccagcttcactgtggcaatagtct

SEQ ID NO: 23387 - DNA, 2928 bp, Homo sapiens
cggcggcggcggcgcggcgcagggcgcggggcggcatggccaccaccgcgcagtacctgccgcggggccccggtggcggagccgggggcaccgggccgcttatgcacccggacgccgcggcggcggcggcggcggcggcggccgcggagcgattgcatgcaggggccgcgtaccgcgaagtgcagaagctgatgcaccacgagtggctgggcgcgggcgcgggccaccccgtgggcctagcgcacccccagtggctacccacgggaggaggcggcggcggcgattgggccggcggcccgcacctagaacacggcaaggcaggcggcggcggcaccggccgagccgacgacggcggcggcggcggaggtttccacgcgcgcctggtgcaccagggggcggcccacgcgggcgcggcatgggcgcagggcagcacagcgcaccacttgggcccggccatgtcgccctcgcccggggccagcgggggccaccagccccagccgctcgggctgtacgcgcaggcggcctacccggggggcggcggcggcggcctggccgggatgctggcggcgggcggtggcggcgcggggccgggcctgcaccacgcgctgcacgaggatggccacgaggcgcagctggagccgtcgccgccgccgcatctgggcgcccacggacacgcacacggacatgcacacgcgggcggcctgcacgcggcggcggcgcacctgcacccgggcgcgggcggcggcggctcatcggtgggcgagcactcggacgaggatgcgcccagctcggacgacctggagcagttcgccaagcagttcaagcagcggcgcatcaagctgggctttacgcaggccgacgtggggctggcgctgggcacgctctacggtaacgtgttctcgcagaccaccatctgccgcttcgaggccctgcagctgagcttcaagaacatgtgcaagctcaagccgctgctcaacaagtggctggaggagaccgactcgtccagcggcagccccaccaacctggacaagatcgcggcgcagggccgcaagcgcaagaagcgcacgtccatcgaggtgggggtcaaaggcgcgctcgagagccactttctcaagtgccccaagccctcggcgcacgagatcaccggcttggcagacagcctgcagctggagaaggaggtggtgcgcgtctggttctgcaaccggcggcagaaggagaagcgcatgacccctgcggccggcgcgggccacccgcccatggacgatgtatacgcgcctggggagctagggcctggcgggggcggcgcatcgccaccctccgcgcccccaccgcccccgccggcggcgctgcaccaccaccaccaccacacactgcccggctcagtgcagtgaccccgcgggccgggcccccgccggcgcgctgcagggcgcgggcgcgcagcccgcccgcgcggcctggactctttttgttcggttgctttggattttacaaaaaaaaaaaaaagcccagaaactttcgaacaaaaccaaacacccggacgaccctctccggtgagcggcgaagacagcccggtaggctgcgtcgcccgagccccgggagagaggagcgaagatccggaactcgccaactcaccccgggcatcctgcccgccgcctgctctctgcccccatcccctcgacgacccccgcccctgcccccccgggctgttcggggccggatcccggcagcggcctccccaaagcgacaggtaacgcagtgcggggttagggattccccgggagagaggacgaagcgaggagagttctccatcccctctccccgcgtggactcctgagcctgcgggtccagggtggggggctgtcactttattcgctacacgcctcttctctcctataaggatgcgccccaccccgctttcccctttctccgggcttggttttttacggtttttatttattcgtggagcctctcggctcctggggtccttctaactccgcccgcgcccttaatttaaatcgcagtatactgtatttatcggggccccggaggggaggtcgcgagagccgcgtctgtgtataaaagcaggaaatagccaaagctttaatctagcctaatttatttttccccttatatttccctaccctaccctccccccaaaaaaaagcaaaaaaaaaaaaaaaaaactaacaaaaaaaattcgagtgttcatttttcgtttcgtttcatccgagccccggcttggttcccggccacgccggaggggtctgcgctcccacacacccagacgggaaggggcttctgccctgctgcagaccgaccgccgcatagcgcggcccctgctccccgcggggccctgccctcctggccacaccaaacgaaacttggaaaagttagagagattgttttttaaccagctgtagaaataagccgttccctgagaaccctccgcctgattccctgcagcttccctctgctccctttccagcccgccgggatgcgggatgccaggggaggccgggagagaaattccccaagtttggggtgaggtgggaaccatgtaaatatgtgagatatgtacacactggcggggagaagaaacattttgtgcttggtttttatttttggttttccgggttacccttccttcctaccctaaaggattttgtacactgactaatccgaaaaagatattttaatatgatttccgaatttctgacccatctctatttattttctggatgtgtttggagcttcccccttctccgtttcttcttctgtttgttaaggtttgaatttaaattttgttattttatttttattattttttgaaacaatgtttcggtgcattctctttgtatctttattgaaaaaaaaataatgtagactgggaagttccctttatatttatgttatagtaaatattttatt

SEQ ID NO: 23388 - DNA, 4081 bp, Homo sapiens
agtaatagcaggagcagcaacagaaggcgtcggagcgggcgtcggagctgcccgctgtgggagagagaggagacagaaagagcgagcgaggagagggagcccgaggcgaaaaagtaactgtcaaatgcgcggctcctttaaccggagcgctcagtccggctccgagagtcatggcgaccgcagcgtctaaccactacagcctgctcacctccagcgcctccatcgtgcacgccgagccgcccggcggcatgcagcagggcgcggggggctaccgcgaagcgcagagcctggtgcagggcgactacggcgctctgcagagcaacggacacccgctcagccacgctcaccagtggatcaccgcgctgtcccacggcggcggcggcgggggcggtggcggcggcggggggggcgggggcggcggcgggggcggcggcgacggctccccgtggtccaccagccccctgggccagccggacatcaagccctcggtggtggtgcagcagggcggccgcggagacgagctgcacgggccaggcgccctgcagcagcagcatcagcagcagcaacagcaacagcagcagcaacagcagcaacagcagcagcagcagcagcaacagcggccgccgcatctggtgcaccacgccgctaaccaccacccgggacccggggcatggcggagcgcggcggctgcagcgcacctcccaccctccatgggagcgtccaacggcggcttgctctactcgcagcccagcttcacggtgaacggcatgctgggcgccggcgggcagccggccggtctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtagggacactccaccacaccacggggtgcagacgcccgtccagtgaactcgagctgggggaggggcagagcgcggggctccccctccccttcggtccttggccctttcccggccctcttgttccctctctaacttctgattgttcttttatttttaattattatttccccgtcccttaaaaagacaaaaaaaataaggcaaaaggaaagcaactaagacactggactatcctttaaaggtagcaggtgtaatgatgtgttttgacctttgcaggcgagtaaccaggcaatggagtggagtgtctcctggagagagtgaggagagtgtgtgatagctagaaagagagagagacagagagatggcaagcactgagataaatacctggcaaaactaaataaattaccaaaaaggaaaaaaaatccaccaaaccatgataaacacaaaatgcagcttcctgatgcttagagttggcacatgctgctgtgtttatttattgtggattcccatcaggaaagaggaaaaaatacacatgttctttcatataggcaaaatttaaccacataaatttgcactgcaagaaaattgaagtttacgtgaacaaattcatgagcatattttctctttctccccaccgttaatttgggagttgccgttttgggggattttgttttgctttgctttattcatcggagagagttgaagccagctcttggccactctccatttctaatgttcttgtgttgccccttcttcgtactgtttgtgaactttggttaccttcacattccccttacgagggtgtaacatctatttgttcctcttaccaaagcaaaaggattggcttcatacaaaatagacaattctctgatttcaggaaatgtgcatggtctacccgctttatcgaaggcaagaatccggtttggaatataaaaataagcattggttgttcttaccagccacaaagtaaacttcattttcaggcagtgtttctgggggaggttatggagggaagaaaaaagaaaaatcgatagtgagtgactgattgcttcattttatcaggcgggcccattgtgaaagagctcaggggaaatgtggaggttaaatatatttccagagttgtccagcagaaagaaagtggcactttgaagagaactagggaagtacatatcttcagatatccctatatagttctctaccttcagttttagtaacaattatgaagaattatttgtgctgacagcagcagttaaactttgtttctctaatagctttttttttacataaaaaaagacccaggaacttaatagtgtatgcataagactgtgttttttagcacacagatacccacagcatacactgacgatctccacgcagtagacaggttttgtcttcactagctcatttgtttatcaagtcatatttagggtcccacaccctcttttcctgtaatttattgcagaatacaccactttgacttggacagctttctgccccctctttcactaaggaaggcaaatgaagtgaaaaaaaaaaatgccattttcaatccttcctttctcccctttgttaatagttttaagtgaatttttgaccttatcttaatggaaaacggttaactccaaacacaaaagactctactggaaagtgtaggtgaaaaaacttgtaactgtattgaaaataaataccattaaactgtgatcagttaaaatttaaaagaaaaatcagcacaaaagggcgctaaaagggaaaacactttttattaatcttaaaagtttgggggtttttttccagttaggtattagataaatttttattttaaaaaatgaaagtctcactaccataaaattatggttcagcatcagattagcattgcactcagtagtctttaaggttttaggaaatatgctttatattgtcttttcaaacacctgtgattgtttcattttccatgtttttgcaagataaatggtgacttataatgggcatatttatttgcctgtatttcatttcccccaatgaatgtcacaaggagatgggcacggagctgcttcgggtgcatcacgctgctcgttcctgaggtatgggaactggcctttagtgaagctatccagagcagggcaaatagccactggtaaagggaggaaatgaatttccagatacttattaccaagtaggtaaggtcagaagctggagttcagagaatgtgtctacagcttctctgactcttataggtttactaagatgaaagttaccactgaaccttaccactatgtatatatgtttaatatctgtcttttgaaatgcagaaatagtttaaatgtttctttgtctatttttctttttttttaatgctacccagggaaatattttcatatcatttttaagtggcctgcctcaatgtatatttatttcttttgaaacaaaaaggttctggaaactgtttttctgtagctttaaatgaataggtgagcaaaatctatatgggatgtaatttttttgttcagtctcttaaaaaatactttgttttggtacatttggttgtgcttgtggggaaaataaaaacgcagagatccttatatatttatgttaaagtaatattttattatctacataaaacagaaatgc

SEQ ID NO: 23389 - DNA, 1131 bp, Homo sapiens
atggcgaccgcagcgtctaaccactacagcctgctcacctccagcgcctccatcgtgcacgccgagccgcccggcggcatgcagcagggcgcggggggctaccgcgaagcgcagagcctggtgcagggcgactacggcgctctgcagagcaacggacacccgctcagccacgctcaccagtggatcaccgcgctgtcccacggcggcgacggctccccgtggtccaccagccccctgggccagccggacatcaagccctcggtggtggtgcagcagggcggccgcggagacgagctgcacgggccaggcgccctgcagcagcagcatcagcagcagcaacagcaacagcagcagcaacagcagcaacagcagcagcagcagcagcaacagcggccgccgcatctggtgcaccacgccgctaaccaccacccgggacccggggcatggcggagcgcggcggctgcagcgcacctcccaccctccatgggagcgtccaacggcggcttgctctactcgcagcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtagggacactccaccacaccacggggtgcagacgcccgtccagtga

SEQ ID NO: 23390 - DNA, 4961 bp, Homo sapiens
atggccacggcggcttctaacccctacctgccggggaacagcctgctcgcggccggctctattgtgcactcggacgcggcaggggctggcggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgccgggcgcgacgacctgcacgcgggcacagcgctgcaccaccgcgggccgccgcacctcggacccccgccgccgcccccacaccagggccaccctgggggctggggggcggccgccgctgccgcagccgcagccgccgccgccgccgccgccgcgcacctcccgtccatggccgggggccagcagccgccgccgcagagtctgctctactcgcagcccggaggcttcacggtgaacggcatgctgagcgcgccaccggggcccggcggcggcggcggcggcgcgggcggtggagcccagagcttggtgcacccggggctggtgcgcggggacacgccagagctggccgagcaccaccaccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtgaagccagggcgcagagcgaagagggccgccgccgccgccgcctccgcagccgccgtcagcaccgccgccgcccctgccgccgccgccgccgccgccgccgccgctgccgccgccgcgccgaccctgcacctgggccgctccgggctccagcccaggcccatccgccgccctcccctccacccagagacaggcatgcccgcccttggaggagaaaacgcgggagaaacggaccaaggaggcatttttgcagtccaaggaaggaggggccaaaaaataaaaagcataataaacacccagactgttttgtatacatatataacaaacaaaaccggaagagaaaaagggggcgatcatgagatctcgttcatactgtggtggtgtttcgtttttgtttttgtttttaaagaagggtgaagatgcctgacgcacgaaaactgcactcgtgaggtttttccaccctgagatgacctacacggcagcggtggacagcacctgcctcgtcttctcctctttgaaaaaaagagagagagagagtcccctttcctttcactttctccctccaaaacagctgcctaaagagatccacggaaactttatttcctgggagcgacctgagagaaaacagaggcaccaggttccatcaggggacgacaccgtgctctgggaccctgtttttcttggccatattaaagtcatttggaaacaaatcaactctgaaatgggaaggaggggggaaaaacagtctccaagaaaaaaataattatattgacagcttctgaaactaacagactgaatagcaaagccaaaagaaaagtatcctcaaagtaaccttggaaataaaaggatcgggaaggagcagagggagagggggaacgtccgctgaggagtggcgagaggccccggccgagtcgggtcgcgggcgggcgggcgaactgggagcagagcgggggcccagccagcgaggccgccgagccaggcccggccgcgtacccaggctttgacggctgccattcagggtggacgatgcctaaagattccaccgctaatattttttttattaatattttttattttttatttctggactgactcagataaaggaatttagaaagactgagcaccagccgctgcacttctctggacttctctcctcaatccgttgccaactttgattgaatgggtgctgtggatgtgattatataatactgccatttccaagcagtgtttttggtaggttttaataaacagacttttcaaaagacggcaatatagaattgttagatccgttgttgatctaaaaatatttgctttatattttcattaaatgacttcttttaatattttattcagaatacttatgaactgctgcaaaacggtaatttatttttccccagatcttgtattacgtgtttttttcagacgagcacaaatcaaaatgaaatgaaaatatggacagttgttaggtaataagggtatcttttgatgtgatcatttgattgtaatttaatttgagtagtgattccgtaagagctgatcgagaaaataaatttgttagaatgaaatagtctgtgtctgatgcgtaaacactgtgtgggaagaaaagagttctttaagaaatatttttttactaatgaaaatccctaagtaatagcgttgaggaagtagagcctgctccacttaaggtacttttggaaatctagagtaaagcataggcattgctgagacagctagtattttaacatagtagtcactcctcgataatccataaattcacaatatttttctctcccttaattttagtggatgtctttagtgttttcaggtgagattgcctaaatattaacccttttcttggcgatacctgtgtttcttatcgaaagattgaacgatatcaccagtaaaaatgagccaactggctattaatggttaatacagcccctccccccaagttcagcttcttttttcttctcctgtccccctcccaacatgttcctgtctcttttctctttttctcaagactatagttgttaggagtcgcttataagtcttataaaatattttgatatcaattacttcccatcaataactatatgtaattaaatttaaattattaagctttttgggttttttccccccgtaataaaagaatatagttctaaaatcctgattatggtccacactgcataccatctgtgcaattaccaactcagacttaaggttctatatttctgtgtttttgtctctccccagtatgattctatatcttctttactggtgctgggggttttaggtcaccttttacataaaccctgcagagtggtcacattgatcaagttaatgtttcaatatttacaatgtgggaaaatgaaagtgtaatgcctcaggttgtgagtacttaagacgctaaaggctcggcttagttgagtccctatatattgtacttaaaagtatttagcagtggtagagcaacgattttatagacaaattccccccaatctcacttagctgtcactcactttttttcctccttctctcatcttcactccctctccctgtgatatcaatgcaggggttaaaaaacccggaaaactgtgagagcaacaaggcacagttatttctcccagacaggccctgtgtcactttcataaatcaaacccagccagatggccatgtattgggttgcattattttaaacaccaaatcgtactaaaaatcacaatcattttgatttgtgaaatctgaaaaaggccacatatattaaacagagagaagaaaaaaatgaagacaagaaaccacaatttacttttctttgccttcttgttccctatttctcttgctgctgtaatccctatgcccagcaaatttacaacctggagtgggggtgggggagaagttcaccattttgggggtgtctagagaggcaagcaaagaagtcctcattggaaagctgaggactggtcaggttgtttttatgtggtggatactactggcacgtgagatggaatcttgtttttcctatgggaatggtggtggttgattagacaagtaataggtctattaaaaaaatttcaggaggtatctacttagttgatttagctgacaacaaaagagctaacattagatttcacactgttttctattaaaaagcaaactttgctgattactttggaagaatccctgatttgggggtagcagagtaacttttaattggagaagctgggaaagcaaacccattttgtttcattatttgcattttataaagtgagctaatgcttgcactccattttttttaatcaaccctttcaatgtaattacaaaatgaaattcatggttgaaaaacaaaagagggcagatataactgagaggttttgtgctaaggcttatattgttacacatgtaaataatgaaaatattgttatatatcaccagatctttttaatgaatttggtcattgtgttc

SEQ ID NO: 23391 - DNA, 1507 bp, Homo sapiens
agatgtcaaaggctgaagctgctccctttgccacattataactagtaggggatcctcaccgaccatggccacagctgcctcgaatccctacagcattctcagttccacctccctagtccatgcggactctgcgggcatgcagcaggggagtcctttccgcaaccctcagaaacttctccaaagtgattacttgcagggagttcccagcaatgggcatcccctcgggcatcactgggtgaccagtctgagcgacgggggcccatggtcctccacactggccaccagccccctggaccagcaggacgtgaagcccgggcgcgaagacctgcaactgggtgcgatcatccatcaccgctcgccacacgtagcccaccactcaccgcacactaaccaccccaacgcctggggggccagcccggcaccgaacccgtctatcacgtcaagcggccaacccctcaacgtgtactcgcagcctggcttcaccgtgagcggcatgctggaacacgggggactcaccccacctccagctgccgcctctgcacagagcctgcacccggtgctccgagagcccccggatcacggcgaactgggctcgcaccattgccaggatcactccgacgaggagacgccaacctctgatgagttggaacagttcgccaaacaattcaaacaaagaagaatcaagttgggcttcacgcaggccgacgtggggttggcgctgggcacactgtatggtaacgtgttctcgcagaccaccatctgcaggttcgaaggcttgcagctgagcttcaaaaatatgtgcaagctgaagcccctgctgaacaagtggctggaggaggcggattcgtccacagggagcccgaccagcattgacaagatcgctgcacagggccgcaagcgcaagaagcggacctccatcgaggtgagtgtcaagggcgtactggagacgcatttcctcaagtgtcccaagcctgccgcgcaggagatctcctcgctggcagacagcctccagttggagaaggaagtggtgcgtgtctggttctgtaatcgaagacaaaaagagaaaagaatgactccgccaggggatcagcagccgcatgaggtttattcgcacaccgtgaaaacagacacatcttgccatgatctctgactggaggaagcgaggaggcggccggccgcactgggagcagcgcggatttctctttctctctcactctcttcctttcattctagtattctttattatttttctctctctctcgttcgctcgctctctcgtactctctctcttttccctcctttcctttttctttcctttcccctttttctttcccttctttttccctttcctttcctttcattttctttcctttccccttcccttcccttcccttccatctcttcctttcctttcctttcttttcttttgctttcctttcctttttttcccttttctttccttttcataagaggttctaacttctgttgacaaaggaaacacatactc

SEQ ID NO: 23392 - DNA, 3795 bp, Homo sapiens
agcgggaccgcgaggccggcgcgcggcgctctgcgcggtcagagggagcgcctggcagcagcaggagcagcagcagcagcccgcggcggggccgccgccagccgccgcgaccgccgcggctgcagcctccgaagggaggccgggtgagccggcgtacgcactttcccgcggactttcggagtgtttgtggatatacatgccaagccgccacgatgatgtccatgaacagcaagcagcctcactttgccatgcatcccaccctccctgagcacaagtacccgtcgctgcactccagctccgaggccatccggcgggcctgcctgcccacgccgccgctgcagagcaacctcttcgccagcctggacgagacgctgctggcgcgggccgaggcgctggcggccgtggacatcgccgtgtcccagggcaagagccatcctttcaagccggacgccacgtaccacacgatgaacagcgtgccgtgcacgtccacttccacggtgcctctggcgcaccaccaccaccaccaccaccaccaccaggcgctcgaacccggcgatctgctggaccacatctcctcgccgtcgctcgcgctcatggccggcgcgggcggcgcgggcgcggcggccggcggcggcggcgcccacgacggcccggggggcggtggcggcccgggcggcggcggcggcccgggcggcggccccgggggaggcggcggtggcggcccggggggcggcggcggcggcccgggcggcgggctcctgggcggctccgcgcaccctcacccgcatatgcacagcctgggccacctgtcgcaccccgcggcggcggccgccatgaacatgccgtccgggctgccgcaccccgggctggtggcggcggcggcgcaccacggcgcggcagcggcagcggcggcggcggcggccgggcaggtggcagcggcatcggcggcggcggccgtggtgggcgcagcgggcctggcgtccatctgcgactcggacacggacccgcgcgagctcgaggcgttcgcggagcgcttcaagcagcggcgcatcaagctgggcgtgacgcaggccgacgtgggctcggcgctggccaacctcaagatcccgggcgtgggctcactcagccagagcaccatctgcaggttcgagtcgctcacgctctcgcacaacaacatgatcgcgctcaagcccatcctgcaggcgtggctcgaggaggccgagggcgcccagcgcgagaaaatgaacaagcctgagctcttcaacggcggcgagaagaagcgcaagcggacttccatcgccgcgcccgagaagcgctccctcgaggcctacttcgccgtgcagccccggccctcgtccgagaagatcgccgccatcgccgagaaactggacctcaaaaagaacgtggtgcgggtgtggttttgcaaccagagacagaagcagaagcggatgaaattctctgccacttactgagggggctgggaggtgtcgggcgggacagaatggggagctgaggaggcatttttggggggctttcctctgcttgcctcccctcggatttggagtgtccgttatcctgcctgcatttggggagtcccttctcgctctctttcctccacccattctctgattttcctgcctttgctgtcccctagccttgaggactggggtgctgggtgtggggattggagtatagggtaggggagaagggggggagcattcgggggagtggggagtggggggaaggaaagcggagacccgagcaggggttttaaggagcaggatggttctggggtttgggtggggggagacgcgggaagggtaggaaaatggactgtttctgaccagagacacttacctaaatatcctggggaccaaggaactatgtacaaaaacaaacctaccaaccaccaaaaactagacaaataaagacaaactaaaacaaaacagaacaaaagcaaaggaaaatgctttagaaattttaactccggggagccataatctgcaacttcattttcccccatagaagagaaaaaagagcaccaccattattaccacctccccaaccctacacgcacgaactgagtcgaaaaacgaaaaccaaacgagcgagaagttgaagttctgggtatcaaagctagttgttctgtctgcgtgtttaatttttccctctctcacctccaccccatccatatcctctttatttcctccgttccaatgagaggcctatggctgctctccaatcccgggaagtgagtgggagcacagctgaaaagagagggtcagggggaggctggctgcttgcttaggtggaatccaagttttcccgtggccctgcctatactctggtggcctggtcctgttggggtgggggtctttggagagaagggcatagtctttgagctactaaaaagcagaattccggagcttcgagatatcttattctaggaaaatgaaacaattttaacaacagttttttttcctcttatgtcgaagatctagttttagacaatttcaaaataagcttttcccactcatagaactttaacttgccctttcagttttatcttttttttagagagaggtttaaactactgatttttcctgttgattcaaatagactaatggggtgaaagttattaggagagatactctctcctgttttctccactgaacgagactcatcttgctcttctaggtcccgtttcttcctctcttggaggacatgaaattatagaaatgttgagaagttcctgctttcttttgcggtaggacttggctgtgagaaaatcacctaaatcccagaaaagaggaagacagatttaaagtgcccccacccccatttgtttcaaagaggtctgcatgttgggcgaaaacagaacaactgtgtttccttttacttgttcttattattcaagagtcatttattacaggggataaatgttgggtagcaagaactttaatttgcactaccagtctcccaaatagaaaatcatgtatagtatttcatagtaataatcaggtaccttacaagctgctggtggattttaaaaaattaagatagttgaaggtggttaggtaaaatgcctgctttgtgtacaagatactctttggatctctcgtagagatggtttgttaccatcctttaatcataactaaaacattgaaaacagaacaaatgagaaaagaaaaaaaacctgccgattaacaagactgaaatcatgcatgatctgaaaggtgtggaaagaaacacaattaggtctcactctggttaggcattatttatttaattatgttgtatatcattgtttgcagggcaaacattctatgcatttgaaactgagcactaaactgggctagctttctggtagaccgttttgtggctagtgcgatttcacagtctactgcctgtttccactgaaaacatttttgtcatattcttgtattcaaagaaaaaggaaaaaagattattgtaaatattttatttaatgcacacattcacacagtggtaacagactgccagtgttcatcctgaaatgtctcacggattgatctacctgtccatgtatgtctgctgagctttctccttggttatgttttttctcttttacctttctcctcccttacttctatcagaaccaattctatgcgccaaaatacaacagggggatgtgtcccagtacacttacaaataaaacataactgaaagaagagcagttttatgatttgggtgcgtttttgtgtttatactgggccaggtcctggtagaacctttcaacaaacaaccaaacaaaaa

SEQ ID NO: 23393 - DNA, 1182 bp, Homo sapiens
cgctgagcagcgctcacttggagagcggcaagcaagctagacaagcctgattccatgtcacccgctgccaccctgccaggagcgcgaagatgatggccatgaactccaagcagcctttcggcatgcacccggtgctgcaagaacccaaattctccagtctgcactctggctccgaggccatgcgccgagtctgtctcccagccccgcagctgcagggtaatatatttggaagctttgatgagagcctgctggcacgcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatctcaagatccccggcgtgggctcgctgagccaaagcaccatctgcaggttcgagtctctcactctctcgcacaacaacatgatcgctctcaagccggtgctccaggcctggttggaggaggccgaggccgcctaccgagagaagaacagcaagccagagctcttcaacggcagcgaacggaagcgcaaacgcacgtccatcgcggcgccggagaagcgttcactcgaggcctatttcgctatccagccacgtccttcatctgagaagatcgcggccatcgctgagaaactggaccttaaaaagaacgtggtgagagtctggttctgcaaccagagacagaaacagaaacgaatgaagtattcggctgtccactgattgcggcagggcgcagcgtcgggagccgggagagcctagtgctcatccctcccgggttcgggggatggttatcggg

SEQ ID NO: 23394 - DNA, 1163 bp, Homo sapiens
gtagtcctttgttacatgcatgagtcagtgaacagggaatgggtgaatgacatttgtgggtaggttatttctagaagttaggtgggcagcttggaaggcagatgcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactta

SEQ ID NO: 23395 - DNA, 1420 bp, Homo sapiens
agagaggggttgagtagtcccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactta

SEQ ID NO: 23396 - DNA, 369 bp, Homo sapiens
atggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagactccgatggggcctccccggagccctgcaccgcatccatttcctttcccactcctg

SEQ ID NO: 23397 - DNA, 1395 bp, Homo sapiens
ccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtgcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactt

SEQ ID NO: 23398 - DNA, 1395 bp, Homo sapiens
ccttcgcaagccctcatttcaccaggcccccggcttggggcgccttccttccccatggcgggacacctggcttcagattttgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtgcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacactt

SEQ ID NO: 23399 - DNA, 1718 bp, Homo sapiens
ctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacaggtgcgtgccaccgtgcccagctaatttttgtgtttttagtagagacggggtttcaccatgttggccatgctggtcttgaactcctgacctcgtgatctgcccacctcggcctcccaaagtgctggaattataggcgtgagccaccgcgcccagcaaagaacttctaaccttcataacctgacaggtgttctcgaggccagggtctctctttctgtcctttcacgatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagaggcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagt

SEQ ID NO: 23400 - DNA, 1233 bp, Homo sapiens
ctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagta

SEQ ID NO: 23401 - DNA, 2335 bp, Homo sapiens
gatggattgctatctctcagcgcagcaggacacggggaccatgcaagctgtaattggtcaggcatgaactctcttgggttgtgttaccctgtttgctgtttactgtcaagatgctgaaagaatgttcttataatgatccaagaggaagtggcaaatgagtgctcttcttcaggatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagcgaatctcaccaacatccaagggctggtggcagcagctgcagccggaggcattatgactctgccactgcaaaatctacaagctacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcaccaaccccactcccactcccagaaccagaaccaaccatctccaacccagcagagctccagccccccgcagaaacctagtcagtctccaggacatggcctgccttcaccgctcacgccacccaatcctctacagctggttaataatccactagcaagtcaggctgcagcggctgcagcagccatgagctccatagcaagctcacaggcctttggcaatgccctctccagtcttcagggggtcacaggtcaactagttactaatgcacaaggacagattatcgggaccattccactgatgcctaatccagggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagctccaccaaccctcccagacgtcagtgggtcaagcagcctcccaaggcaaccttctgcacctggctcacagccaagcatccatgtctcaaagtcccgtccggcaggcttcctcttcttcctcctcatcctcctcttcttcagctttgagcgtgggccagttagtcagcaatcctcaaacggcagcgggtgaggtggatggggttaatctggaggagatccgagaatttgccaaagcttttaaaatccggcgcctgtcccttggcctgacccagactcaggtgggacaggctctcagtgctacagagggccccgcgtacagccagtcggccatctgcagacacaccatcctgagaagccactttttcctaccacaggaagcccaagagaacactatagctagcagtctgacagccaaactgaaccctggccttttgtatcctgccaggtttgaaaagctggacatcacccctaaaagtgcccagaagatcaagccggtgcttgagcggtggatggctgaggctgaggcccgccatcgagcaggtatgcagaacctgaccgagtttatcgggagtgaaccatccaaaaagcgcaagcggcgcacctccttcacaccccaggcccttgagatcctcaatgcccactttgagaagaacacacacccttctgggcaggaaatgaccgaaattgctgagaagctgaactatgaccgagaagtagttagagtttggttctgcaataagaggcaagccctgaagaacacaattaaacgcttaaaacagcacgagccggccacggcagtccctttggagcccttaacagactctctggaagaaaactcctaaagagatgcccacccataatcagaagcaaaattcacagaaactaaactccacccttgggactccacaacaacaacaacaacaaaatttaatttaatttaaaaatag

SEQ ID NO: 23402 - DNA, 5925 bp, Homo sapiens
gctgaaagaatgttcttataatgatccaagaggaagtggcaaatgagtgctcttcttcaggatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagcgaatctcaccaacatccaagggctggtggcagcagctgcagccggaggcattatgactctgccactgcaaaatctacaagctacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcaccaaccccactcccactcccagaaccagaaccaaccatctccaacccagcagagctccagccccccgcagaaacctagtcagtctccaggacatggcctgccttcaccgctcacgccacccaatcctctacagctggttaataatccactagcaagtcaggctgcagcggctgcagcagccatgagctccatagcaagctcacaggcctttggcaatgccctctccagtcttcagggggtcacaggtcaactagttactaatgcacaaggacagattatcgggaccattccactgatgcctaatccagggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagctccaccaaccctcccagacgtcagtgggtcaagcagcctcccaaggcaaccttctgcacctggctcacagccaagcatccatgtctcaaagtcccgtccggcaggcttcctcttcttcctcctcatcctcctcttcttcagctttgagcgtgggccagttagtcagcaatcctcaaacggcagcgggtgaggtggatggggttaatctggaggagatccgagaatttgccaaagcttttaaaatccggcgcctgtcccttggcctgacccagactcaggtgggacaggctctcagtgctacagagggccccgcgtacagccagtcggccatctgcaggtttgaaaagctggacatcacccctaaaagtgcccagaagatcaagccggtgcttgagcggtggatggctgaggctgaggcccgccatcgagcaggtatgcagaacctgaccgagtttatcgggagtgaaccatccaaaaagcgcaagcggcgcacctccttcacaccccaggcccttgagatcctcaatgcccactttgagaagaacacacacccttctgggcaggaaatgaccgaaattgctgagaagctgaactatgaccgagaagtagttagagtttggttctgcaataagaggcaagccctgaagaacacaattaaacgcttaaaacagcacgagccggccacggcagtccctttggagcccttaacagactctctggaagaaaactcctaaagagatgcccacccataatcagaagcaaaattcacagaaactaaactccacccttgggactccacaacaacaacaacaacaaaatttaatttaatttaaaaatagccccagtcgtcatcacccttgtaagtaaatgactaagaaaactaccaagtggacagaatggtttctacatgtccgttggttttccaaaaaggaaagaagaaaatttttagaaaatttttaaacaaggaatacaccacactgaaggtgtgtgtggtaggatagttcccttcccccacctgtctcccccaaagccagttttttaatggacttaaagcaaaccaaataaccacgtacttttttctgtatattatgaaaatgtgaacacattttaaggaaaaagaaaaaaaaaaactaaaccaaaaaccaacaacgaaggaacaaaaactttgatctgttcaaagcgaatacaagcctgccacctggaggaaggactgcaccccttcaggtactaagtgctgattcactatgaaacctattaaccaaagtcagaaacatggcattgcaacgcgatcgttcgtctacgcttctccgcacgtaaagttgtgttacgaatttttacatttgtactaacagaacaataggaagcctgatttctcccatctttcccatctactgtctccacccatggggtgggtaccattgttgaagccattctgtgaggctcactattgggtttttttgtgggggtggtagggagggtggtcttttttctttgtctttctttttgacgggagggcatcctggatcgtgtgccaaagcatttgttgcttttttctcactatgacttgtgggtttgagaaaagaaaatggagctcgcatttctctcttttcctccatttctccatctccctcgcgcgtggctcctggggtctgctggaaggccacagaagtggggagaagcagtgtcttttccactcagatcctagtgaaatgcaggagagactccaaaataactagggctttgctcgatgaactgtcaacactggcataagctgtaattgtgctcactgtccacaccagagcttgggatttttctcagtctgttggccacgtacatggagagctgaccaaaactaattttgtaatataaacataagctgcacatttggttcaatacttacatctatgttatgcttctgtgcaaagcaatttctctcagaagtctgatagccaaagaaatgtctcaagatttcagtcaaatacacacatgacatgcacacacccataaacacacacacaaagaaacaggctaaaaagaaagtgatagcaactggatcattaaaggccatcgtgtatcctgttaatctcatcttttctgctacttctttcattccaatagcgatggcagacttttttcagggggaataattactcttcgggatatataaatggagcagaaaggtggcgggcaaatttaaacaactggaattgggggccaggttcttcaggggaaaggaagtttgaagaagctttcaccaaaagaaaaaaatatagaaggggcttatctaacaatcagaatagcctgcaatatgagaactagaggattatttcctttaaaaaaaataacttaaaagatctgtgggccacaataacctaataagcaaggacatgttgggatgtgaggacggctgtgcaggtgagcacttggcagctgccactggtgttttcacccaggtacaggcagacggtgttccattaaaggagcaggcaaaagagagctgtcaatttgcttgctgttgaaatgtacatatttatgcataatttataatcatgctaatgtattatctagaagtaagttgtgaaagaaaaaagagaaacccaatctcaagttgcccaactgattagaaatgccatctccttcccctaatacactccctctccctggggagtttgagtttcttctgttggctcctttgctgtttgtgtaaatgctacagtataattgtcccctccaatgattcatgcagcaatcaagagactaccagcaaggaaactctaaaaggaatcctggaagtggaacaagtcactcgtaaaggtgtttccattttaccagtcaatgctaactggaccacagctaacttgatcttcaatgccaacatcacagagcccctttcgccacctcaaaaactgcacaaacatggacaacccagaaacccaaaactttattgattaaaacagattttggattctcctaggacctgctccaaattccatcaagaaaagctccctgcgaagagaagttaacaagataacatatgatggatgctaaatatttaaatatatgccggcagcggttacataaggcctgctcagttctgagatctataattgggagggtctaactaggacagggaaaatataaaataaaagtaatcttccagagtggaacaaaaaagaaatatattcatccgacagtcgtaacaccattcatgtgcagtgatttttttatagttttataattttgtattgttttataaattatttataaggtgttgtaatgcttcttatattaattttttacagataaattttttgctacaaggcataaaaaggtgcctgaaccgattcttaggaatataaattatactgtgtaactcataagtctttgggaccacacctaatgcttaattttatgatgacatttctcatgtctacttgtaaacaacttcatatgccaatggcgtttaagtgtcttttatgtttccatgaactgaaggttaaggttgccacccacaaaaaataaaagccactttgggcatatgtgattgtatttcaagcttcagtatttttctcacataatttttaattattgttatctgcattttcattacttcatgaaaaaatgacagtggatattacattttacacttgtttatagattttctttctttttcaaccaagaaaatattttgaacaattgaaacttttaattgcatttgcaaggttttggcttctttatgttgtcatcacacagatgcacacacacatacacatacaacacaaaagagagaacaaaaaagcaaaaggagctaggaaaaaaacaaaacaaaacaagtagaggtgtatcaaagaactcaagctataaccaaaaagaaatcgtaaaatgcctttgctcgtttctctacgctggaccaaagctcaatatttgtaggtatatgcacattgtatagatatggctaaatgttgctgacaatctcgcaatactaaactgttcctattttaagaaaaaaaaaagaaatacaaactgttcatcaatgttttacctcagcactctacttgtacccagttaatgaccaagcttaaaaaaaaattgagataaaggaaattgattttcatttcaatgtttgactgtaaaatctgtttggataacattttgtaatgagctttttgtcatgtgatttgcttgtcttcaacttgaaattatgtgaggcacatttgtttatttgttgttaagaaagtgatttttttttttttttgtcctatgtgctgtgatctagactggtcaccggggtcacttatgaggcaccacaaagagatctgcttctccgtgcccggagcaggcagcaggagggagggcaggaaacaggactgggttgctttggaaaaatcatcatgacaagaagttgacatgatagacttgtgaccaagaagccaaactgaatatttaaaagctccttacttgctctgacattgaaaccaaagctgattttatctgcacaggttgcttaatatttaaaaaaaaaaaaaactgtacttaatctagagcaatatctgtatggtcagtaaagctgcactttgtgtatttcttaacagcttcagatctgtcacttttaatttgtaccataaaaaataaataattgtttgacatga

SEQ ID NO: 23403 - DNA, 4675 bp, Homo sapiens
cagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaat

SEQ ID NO: 23404 - DNA, 2612 bp, Homo sapiens
gggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattt

SEQ ID NO: 23405 - DNA, 5164 bp, Homo sapiens
gggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggtgcgcgtctgtgcggctcagcctggcgggggacgcggggagaatgtggactgggtagagatgaacgagacttttctcagatgttggatatttgcttggaaaaacgtgtgggtacgaccttggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaa

SEQ ID NO: 23406 - DNA, 583 bp, Homo sapiens
ccttttcagtcttccatgtgagaggatgaaagagagctcgcagcagagggaggaggcagttgttttgaaagttgttttgcgttgggagctggtgggaaagttcggtcttccccatttggaaaaggcaggctgggttccgctcctgcaccacacgcgctttccatttttagcttcattcagaggcagacagagctccttcctcttcctctccttgtttgtgacacttttctgaggcagcttttccacagtgccgagggtctggcggccatgaccccaggcattctgggacactggactgtgtgcccagaacatttttctgccatgagaggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttatt

SEQ ID NO: 23407 - DNA, 4247 bp, Homo sapiens
ggcaagagcagcgaccgcggcacctgtccgcccggagctgggacgcgggcgcccgggcggccggacgaagcgaggagggaccgccgaggtgcgcgtctgtgcggctcagcctggcgggggacgcggggagaatgtggactgggtagagatgaacgagacttttctcagatgttggatatttgcttggaaaaacgtgtgggtacgaccttggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgcccaccccatgctcaaccccacttctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaaggg

SEQ ID NO: 23408 - DNA, 2344 bp, Homo sapiens
aattccctaccctcgacctgtcgatgccccgcggccccgcccgccctcttaagcctggctcagccctcagggcccgcccgaagtctaccgagcccgagtggcctaccgagcccgagtggccccgcagcgtccaggaggcgcccgctccgcggtggcgctcttggaggtggtgtcggagagccgccgagcgtgcggtcccgggatggctctaccccggccaagtgaggccgtgcctcaggacaaggtgtgctacccgccggagagcagcccgcagaacctggccgcgtactacacgcctttcccgtcctatggacactacagaaacagcctggccaccgtggaggaagacttccaacctttccggcagctggaggccgcagcgtctgctgcccccgccatgccccccttccccttccggatggcgcctcccttgctgagcccgggtctgggcctacagagggagcctctctacgatctgccctggtacagcaagctgccaccgtggtacccaattccccacgtccccagggaagtgccgcccttcctgagcagcagccacgagtacgcgggtgccagcagtgaagatctgggccaccaaatcattggtggcgacaacgagagtggcccgtgttgtggacctgacactttaattccaccgccccctgcggatgcttctctgttacctgaggggctgaggacctcccagttattaccttgctcacccagcaagcagtcagaggatggtcccaaaccctccaaccaagaagggaagtcccctgctcggttccagttcacggaggaggacctgcacttcgttctgtacggggtcactcccagcctggagcacccagccagcctgcaccatgcgatttcaggcctcctggtccccccagacagctctggatctgattctcttcctcaaactctggataaagactcccttcaacttccagaaggtctatgcctcatgcagacggtgtttggtgaagtcccacattttggtgtgttctgcagtagttttatcgccaaaggagtcaggtttgggccctttcaaggtaaagtggtcaatgccagtgaagtgaagacctacggagacaattctgtgatgtgggagatctttgaagatggtcatttgagccactttatagatggaaaaggaggtacggggaactggatgtcctatgtcaactgtgcccgcttccccaaggagcagaacctagttgctgtgcagtgtcaagggcatatattttatgagagctgcaaagagatccatcagaaccaagagctccttgtgtggtatggagactgctatgagaaatttctggatattcctgtgagccttcaggtcacagagccggggaagcagccatctgggccctctgaagagtctgcagaaggctacagatgtgaaagatgtgggaaggtatttacctacaaatattacagagataagcacctcaagtacaccccctgtgtggacaagggcgataggaaatttccctgttctctctgcaaacgatcctttgagaagcgggaccggcttcggatccacattcttcatgttcatgagaagcaccggcctcacaagtgttctacatgtgggaaatgtttctctcaatcttccagcctaaacaaacacatgcgagtccactctggagacagaccataccagtgtgtgtattgtactaagaggttcacagcctccagcatactccgcacacacatcaggcagcactccggggagaagcccttcaaatgcaagtactgtggtaaatcttttgcatcccatgctgcccatgacagccatgtccggcgttcacacaaggaggatgatggctgctcatgcagcatctgtgggaaaatcttctcagatcaagaaacattctactcccacatgaagtttcatgaagactactagccctgccaggcacaatgactcacgcctgtaatcccagcactttgggaggcagaggtgggtggatcactcaagtccaggagttcgagaccagcctgggcaacatggtgaaatcctgtctctaccaaaaaaatacaaaaatcagctgggggtggtggcacatgcctgtggttccagccactcaggaggtcgaggtggcaggatggtttgagcacaggagacggaggttgctgtgagctgagatcgccccactgcttttcaacctgggtgacagaaccagaccctgtctcaaaacaaaacaaaacaaaaaaaatgagtagccctcaagagtgtggagacaatgtaaaaacaagagattcggattctctctatttccttttatgggttatagaagtccctgcagttggctgtgtgtggtggctcacgcct

SEQ ID NO: 23409 - DNA, 422 bp, Homo sapiens
acgccgccttcgggcaggctgggatcttccgaactgggagcggagagtaaggggctcgaccccgggacgcgagtccggccttctggactccggttcaggagccgccgagcgtgcggtcccgggatggctctaccccggccaagtgaggccgtgcctcaggacaaggtgtgctacccgccggagagcagcccgcagaacctggccgcgtactacacgcctttcccgtcctatggacactacagaaacagcctggccaccgtggaggaagacttccaacctttccggcagctggaggccgcagcgtctgctgcccccgccatgccccccttccccttccggatggcgcctcccttgctgagcccgggtctgggcctacagagggagcctctctacgatctgccctggtacagcaagctgccacc

SEQ ID NO: 23410 - DNA, 8690 bp, Homo sapiens
gctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcagatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagcagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtcccccccatgaatcctgctgtccctgctgccgtttaccagacaatcatatgtttttgttaaatttgcgtttcagttacatttgcatttaagacaagtgttctatttatttcttgtattgtttggaagaaaaaatgatgatagagtcccaaaaagaagagaaaaaaaatgcccaagttgccctttaaaaaaaaagagcgtaaatacaaacaggagtggtgcaagccgccttggtgtgggtttgtgtcacgtgtggacatctcctcaggctttgtgtcacgcgtggacatctcctcaggctgtccccagcggtgacgggaggtgtcctggctgctccaggacaaaagacaatcgtctctgtgggtgccgggtggtccaggcttgcactgaagacgtgccacggggaggctcctgcaggaggctcaacccgacggatcacagtgaaagggattcctcccacgccagatctgcacaacgaggcaagacaggacccacctgtgcgtgcgctggggccatggggtggccccgccggggcagcgggggagctgcctgcagaagagccagctggcgtgtcgggaaggatccaggatctgcaaacacaactgctcaggccttctcacgcgtttccacaacatcccctgggtcagacccaccaggtaccccgtaggaatttccagtttcccttgatctagatgggattcttataaaaattcaacctcagacataaacaccccatttctgtaaacccaaattatatggtttcttctgcgaaagagtaaggtgtgtgcttttttttttttgcaatatgaccccgtctctctgaagtgggacattcggacggatggagccctcagcgtgtcttttcagcaggagcagaaccgatgagagccgcccttaccgttggtctccggatcccccagtcccatcccgccgttttcggctgtcttcctaaccgtcctgtcttctcttggcgctctttccttccacctttcccaagagtcctggttgcacgttttaagtcatatattttcgtccccctgaaaatgatggcaagcccagtttctcctgagcattcagacccccaggccccagcacttggcgttttcaggaggccctgttcttagagcccctgacaaaggcagcacttatttcctgggctggtgcgccccaaaacacggccccgacacttagtgtggccccaggccccagcgagcctcgccctcccagttttgctctgcccagcagtgttggtgcccagagatgacaagggccagggagcctggcccgggtgtgagaattcagagattctggcctccagctgtcaccacaccgtaacggggccatgtaactgtgcagcatggacagggatgcgacggggcagctggctgtgtccatggccaggtggccagggtcagggctgcaagccaggggtccagggcccttccgttcagcccaaatgctgccccaatgctaactccttggattgtcaacccccatcccccaaatggaaattccgaaggaggcctcctcgcacctgccctccgctgctcctcagaccccagcccccagcgagccgacgtccccacccgttcctgctctcatccccaggttgggcacgtggggttcctcctctgtgggcctggcagacccttcatgagtgggacccaagatatcactgacttcaacccagaggatcgagcccctgcaccctgcctggggccctggggtgtggagcagtggctggggtgggcgtggtgtggcctgagagactgcccagctggagaggccttcctttacaaggccacgcgtgcagctgtcccatccagaccccgactggccaagacctccacgtccccagagtccagccctggaaattccaagggccctggcgtcctctgccttccccgcttccccatgagcgtctgcaaaacacttgcctgaatacatatcacgtattttagactcgaagcctcaaagcactggattgtggtcccctgccccctctgtcccgtccccctgcccaagtgactgaaacctactgagctatattcactgtgctgtcctagggggagggagagcagagctcgcccctgcactgcagccttgtgggggagggcaaggctctcctcccagccagggacgccaggacatagctgctcctggtcagtggaggtcagccgggtatcaaaagccatgaaactgtgtctctgtagcaatgagtgatactgtgacaaaaccatccttgcattcttcctagaagagttcctctgctccttccattccatttttgtgtttgttttgttcttttctgtcactgatccgtattaccacttttggaaaaaaataaataaataaataaataaaaggcagcttgagtttccaaacgtgtgattcacttgtgaacaaaagtcattctaacaattgccttcagcgtcacgtgcattgccactgcgctttcggcacgagggatgctgagccctggtgtcagagtcgtaatttaaagcgtgtgtgtatatggactttgtcccttaaggtcgatataaagaatcctcgcagaatcacagacctgtgccgcccgccaccttctgccattgttacattacagatttggtttagttttgttttgttttgttttttcttttagaactgtatagtattgaaaaagaaatcaaatgtaaatgtctggttttcatataatgtttaaaaagaccattgagaaggaggctggcgctcgccccatgtcccccttgattgtaaattgcttctgttctgtttataagtaaactgtgcatgactcctgcttagcggtcattatcgtgtctgttggtgaaatttttattaaaaggaaaattctgtagatgcacttattgaatatgtgattaggatctacgtctgagactaggagtcctgaactgctgacgcgaaagaggcgcagttcccaattaatacggaaatcgctgtgggagaagaatgaaataagacgtgaagtgtaggaaatcatgaaaagaacaattttgcaaattgcattctgatgcttgtgatgaacacaaatgtacttgtgtagagacatttccttaagagaaagcctaggagaagccgatttggaggttaatgctgtagaataggactgtataccaaatgtaatctttccaatgctccaatgaatttatacatgagattgatatgcaataaatctgtgtgcttttctaa

SEQ ID NO: 23411 - DNA, 8721 bp, Homo sapiens
ctgacaatgctggggagatgaagatagtgtgtggctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcaggtgatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtcccccccatgaatcctgctgtccctgctgccgtttaccagacaatcatatgtttttgttaaatttgcgtttcagttacatttgcatttaagacaagtgttctatttatttcttgtattgtttggaagaaaaaatgatgatagagtcccaaaaagaagagaaaaaaaatgcccaagttgccctttaaaaaaaaagagcgtaaatacaaacaggagtggtgcaagccgccttggtgtgggtttgtgtcacgtgtggacatctcctcaggctttgtgtcacgcgtggacatctcctcaggctgtccccagcggtgacgggaggtgtcctggctgctccaggacaaaagacaatcgtctctgtgggtgccgggtggtccaggcttgcactgaagacgtgccacggggaggctcctgcaggaggctcaacccgacggatcacagtgaaagggattcctcccacgccagatctgcacaacgaggcaagacaggacccacctgtgcgtgcgctggggccatggggtggccccgccggggcagcgggggagctgcctgcagaagagccagctggcgtgtcgggaaggatccaggatctgcaaacacaactgctcaggccttctcacgcgtttccacaacatcccctgggtcagacccaccaggtaccccgtaggaatttccagtttcccttgatctagatgggattcttataaaaattcaacctcagacataaacaccccatttctgtaaacccaaattatatggtttcttctgcgaaagagtaaggtgtgtgcttttttttttttgcaatatgaccccgtctctctgaagtgggacattcggacggatggagccctcagcgtgtcttttcagcaggagcagaaccgatgagagccgcccttaccgttggtctccggatcccccagtcccatcccgccgttttcggctgtcttcctaaccgtcctgtcttctcttggcgctctttccttccacctttcccaagagtcctggttgcacgttttaagtcatatattttcgtccccctgaaaatgatggcaagcccagtttctcctgagcattcagacccccaggccccagcacttggcgttttcaggaggccctgttcttagagcccctgacaaaggcagcacttatttcctgggctggtgcgccccaaaacacggccccgacacttagtgtggccccaggccccagcgagcctcgccctcccagttttgctctgcccagcagtgttggtgcccagagatgacaagggccagggagcctggcccgggtgtgagaattcagagattctggcctccagctgtcaccacaccgtaacggggccatgtaactgtgcagcatggacagggatgcgacggggcagctggctgtgtccatggccaggtggccagggtcagggctgcaagccaggggtccagggcccttccgttcagcccaaatgctgccccaatgctaactccttggattgtcaacccccatcccccaaatggaaattccgaaggaggcctcctcgcacctgccctccgctgctcctcagaccccagcccccagcgagccgacgtccccacccgttcctgctctcatccccaggttgggcacgtggggttcctcctctgtgggcctggcagacccttcatgagtgggacccaagatatcactgacttcaacccagaggatcgagcccctgcaccctgcctggggccctggggtgtggagcagtggctggggtgggcgtggtgtggcctgagagactgcccagctggagaggccttcctttacaaggccacgcgtgcagctgtcccatccagaccccgactggccaagacctccacgtccccagagtccagccctggaaattccaagggccctggcgtcctctgccttccccgcttccccatgagcgtctgcaaaacacttgcctgaatacatatcacgtattttagactcgaagcctcaaagcactggattgtggtcccctgccccctctgtcccgtccccctgcccaagtgactgaaacctactgagctatattcactgtgctgtcctagggggagggagagcagagctcgcccctgcactgcagccttgtgggggagggcaaggctctcctcccagccagggacgccaggacatagctgctcctggtcagtggaggtcagccgggtatcaaaagccatgaaactgtgtctctgtagcaatgagtgatactgtgacaaaaccatccttgcattcttcctagaagagttcctctgctccttccattccatttttgtgtttgttttgttcttttctgtcactgatccgtattaccacttttggaaaaaaataaataaataaataaataaaaggcagcttgagtttccaaacgtgtgattcacttgtgaacaaaagtcattctaacaattgccttcagcgtcacgtgcattgccactgcgctttcggcacgagggatgctgagccctggtgtcagagtcgtaatttaaagcgtgtgtgtatatggactttgtcccttaaggtcgatataaagaatcctcgcagaatcacagacctgtgccgcccgccaccttctgccattgttacattacagatttggtttagttttgttttgttttgttttttcttttagaactgtatagtattgaaaaagaaatcaaatgtaaatgtctggttttcatataatgtttaaaaagaccattgagaaggaggctggcgctcgccccatgtcccccttgattgtaaattgcttctgttctgtttataagtaaactgtgcatgactcctgcttagcggtcattatcgtgtctgttggtgaaatttttattaaaaggaaaattctgtagatgcacttattgaatatgtgattaggatctacgtctgagactaggagtcctgaactgctgacgcgaaagaggcgcagttcccaattaatacggaaatcgctgtgggagaagaatgaaataagacgtgaagtgtaggaaatcatgaaaagaacaattttgcaaattgcattctgatgcttgtgatgaacacaaatgtacttgtgtagagacatttccttaagagaaagcctaggagaagccgatttggaggttaatgctgtagaataggactgtataccaaatgtaatctttccaatgctccaatgaatttatacatgagattgatatgcaataaatctgtgtgcttttct

SEQ ID NO: 23412 - DNA, 8087 bp, Homo sapiens
ttctgcgcatactctgcaaaaatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagcagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtcccccccatgaatcctgctgtccctgctgccgtttaccagacaatcatatgtttttgttaaatttgcgtttcagttacatttgcatttaagacaagtgttctatttatttcttgtattgtttggaagaaaaaatgatgatagagtcccaaaaagaagagaaaaaaaatgcccaagttgccctttaaaaaaaaagagcgtaaatacaaacaggagtggtgcaagccgccttggtgtgggtttgtgtcacgtgtggacatctcctcaggctttgtgtcacgcgtggacatctcctcaggctgtccccagcggtgacgggaggtgtcctggctgctccaggacaaaagacaatcgtctctgtgggtgccgggtggtccaggcttgcactgaagacgtgccacggggaggctcctgcaggaggctcaacccgacggatcacagtgaaagggattcctcccacgccagatctgcacaacgaggcaagacaggacccacctgtgcgtgcgctggggccatggggtggccccgccggggcagcgggggagctgcctgcagaagagccagctggcgtgtcgggaaggatccaggatctgcaaacacaactgctcaggccttctcacgcgtttccacaacatcccctgggtcagacccaccaggtaccccgtaggaatttccagtttcccttgatctagatgggattcttataaaaattcaacctcagacataaacaccccatttctgtaaacccaaattatatggtttcttctgcgaaagagtaaggtgtgtgcttttttttttttgcaatatgaccccgtctctctgaagtgggacattcggacggatggagccctcagcgtgtcttttcagcaggagcagaaccgatgagagccgcccttaccgttggtctccggatcccccagtcccatcccgccgttttcggctgtcttcctaaccgtcctgtcttctcttggcgctctttccttccacctttcccaagagtcctggttgcacgttttaagtcatatattttcgtccccctgaaaatgatggcaagcccagtttctcctgagcattcagacccccaggccccagcacttggcgttttcaggaggccctgttcttagagcccctgacaaaggcagcacttatttcctgggctggtgcgccccaaaacacggccccgacacttagtgtggccccaggccccagcgagcctcgccctcccagttttgctctgcccagcagtgttggtgcccagagatgacaagggccagggagcctggcccgggtgtgagaattcagagattctggcctccagctgtcaccacaccgtaacggggccatgtaactgtgcagcatggacagggatgcgacggggcagctggctgtgtccatggccaggtggccagggtcagggctgcaagccaggggtccagggcccttccgttcagcccaaatgctgccccaatgctaactccttggattgtcaacccccatcccccaaatggaaattccgaaggaggcctcctcgcacctgccctccgctgctcctcagaccccagcccccagcgagccgacgtccccacccgttcctgctctcatccccaggttgggcacgtggggttcctcctctgtgggcctggcagacccttcatgagtgggacccaagatatcactgacttcaacccagaggatcgagcccctgcaccctgcctggggccctggggtgtggagcagtggctggggtgggcgtggtgtggcctgagagactgcccagctggagaggccttcctttacaaggccacgcgtgcagctgtcccatccagaccccgactggccaagacctccacgtccccagagtccagccctggaaattccaagggccctggcgtcctctgccttccccgcttccccatgagcgtctgcaaaacacttgcctgaatacatatcacgtattttagactcgaagcctcaaagcactggattgtggtcccctgccccctctgtcccgtccccctgcccaagtgactgaaacctactgagctatattcactgtgctgtcctagggggagggagagcagagctcgcccctgcactgcagccttgtgggggagggcaaggctctcctcccagccagggacgccaggacatagctgctcctggtcagtggaggtcagccgggtatcaaaagccatgaaactgtgtctctgtagcaatgagtgatactgtgacaaaaccatccttgcattcttcctagaagagttcctctgctccttccattccatttttgtgtttgttttgttcttttctgtcactgatccgtattaccacttttggaaaaaaataaataaataaataaataaaaggcagcttgagtttccaaacgtgtgattcacttgtgaacaaaagtcattctaacaattgccttcagcgtcacgtgcattgccactgcgctttcggcacgagggatgctgagccctggtgtcagagtcgtaatttaaagcgtgtgtgtatatggactttgtcccttaaggtcgatataaagaatcctcgcagaatcacagacctgtgccgcccgccaccttctgccattgttacattacagatttggtttagttttgttttgttttgttttttcttttagaactgtatagtattgaaaaagaaatcaaatgtaaatgtctggttttcatataatgtttaaaaagaccattgagaaggaggctggcgctcgccccatgtcccccttgattgtaaattgcttctgttctgtttataagtaaactgtgcatgactcctgcttagcggtcattatcgtgtctgttggtgaaatttttattaaaaggaaaattctgtagatgcacttattgaatatgtgattaggatctacgtctgagactaggagtcctgaactgctgacgcgaaagaggcgcagttcccaattaatacggaaatcgctgtgggagaagaatgaaataagacgtgaagtgtaggaaatcatgaaaagaacaattttgcaaattgcattctgatgcttgtgatgaacacaaatgtacttgtgtagagacatttccttaagagaaagcctaggagaagccgatttggaggttaatgctgtagaataggactgtataccaaatgtaatctttccaatgctccaatgaatttatacatgagattgatatgcaataaatctgtgtgcttttct

SEQ ID NO: 23413 - DNA, 8718 bp, Homo sapiens
ctgacaatgctggggagatgaagatagtgtgtggctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcagatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtcccccccatgaatcctgctgtccctgctgccgtttaccagacaatcatatgtttttgttaaatttgcgtttcagttacatttgcatttaagacaagtgttctatttatttcttgtattgtttggaagaaaaaatgatgatagagtcccaaaaagaagagaaaaaaaatgcccaagttgccctttaaaaaaaaagagcgtaaatacaaacaggagtggtgcaagccgccttggtgtgggtttgtgtcacgtgtggacatctcctcaggctttgtgtcacgcgtggacatctcctcaggctgtccccagcggtgacgggaggtgtcctggctgctccaggacaaaagacaatcgtctctgtgggtgccgggtggtccaggcttgcactgaagacgtgccacggggaggctcctgcaggaggctcaacccgacggatcacagtgaaagggattcctcccacgccagatctgcacaacgaggcaagacaggacccacctgtgcgtgcgctggggccatggggtggccccgccggggcagcgggggagctgcctgcagaagagccagctggcgtgtcgggaaggatccaggatctgcaaacacaactgctcaggccttctcacgcgtttccacaacatcccctgggtcagacccaccaggtaccccgtaggaatttccagtttcccttgatctagatgggattcttataaaaattcaacctcagacataaacaccccatttctgtaaacccaaattatatggtttcttctgcgaaagagtaaggtgtgtgcttttttttttttgcaatatgaccccgtctctctgaagtgggacattcggacggatggagccctcagcgtgtcttttcagcaggagcagaaccgatgagagccgcccttaccgttggtctccggatcccccagtcccatcccgccgttttcggctgtcttcctaaccgtcctgtcttctcttggcgctctttccttccacctttcccaagagtcctggttgcacgttttaagtcatatattttcgtccccctgaaaatgatggcaagcccagtttctcctgagcattcagacccccaggccccagcacttggcgttttcaggaggccctgttcttagagcccctgacaaaggcagcacttatttcctgggctggtgcgccccaaaacacggccccgacacttagtgtggccccaggccccagcgagcctcgccctcccagttttgctctgcccagcagtgttggtgcccagagatgacaagggccagggagcctggcccgggtgtgagaattcagagattctggcctccagctgtcaccacaccgtaacggggccatgtaactgtgcagcatggacagggatgcgacggggcagctggctgtgtccatggccaggtggccagggtcagggctgcaagccaggggtccagggcccttccgttcagcccaaatgctgccccaatgctaactccttggattgtcaacccccatcccccaaatggaaattccgaaggaggcctcctcgcacctgccctccgctgctcctcagaccccagcccccagcgagccgacgtccccacccgttcctgctctcatccccaggttgggcacgtggggttcctcctctgtgggcctggcagacccttcatgagtgggacccaagatatcactgacttcaacccagaggatcgagcccctgcaccctgcctggggccctggggtgtggagcagtggctggggtgggcgtggtgtggcctgagagactgcccagctggagaggccttcctttacaaggccacgcgtgcagctgtcccatccagaccccgactggccaagacctccacgtccccagagtccagccctggaaattccaagggccctggcgtcctctgccttccccgcttccccatgagcgtctgcaaaacacttgcctgaatacatatcacgtattttagactcgaagcctcaaagcactggattgtggtcccctgccccctctgtcccgtccccctgcccaagtgactgaaacctactgagctatattcactgtgctgtcctagggggagggagagcagagctcgcccctgcactgcagccttgtgggggagggcaaggctctcctcccagccagggacgccaggacatagctgctcctggtcagtggaggtcagccgggtatcaaaagccatgaaactgtgtctctgtagcaatgagtgatactgtgacaaaaccatccttgcattcttcctagaagagttcctctgctccttccattccatttttgtgtttgttttgttcttttctgtcactgatccgtattaccacttttggaaaaaaataaataaataaataaataaaaggcagcttgagtttccaaacgtgtgattcacttgtgaacaaaagtcattctaacaattgccttcagcgtcacgtgcattgccactgcgctttcggcacgagggatgctgagccctggtgtcagagtcgtaatttaaagcgtgtgtgtatatggactttgtcccttaaggtcgatataaagaatcctcgcagaatcacagacctgtgccgcccgccaccttctgccattgttacattacagatttggtttagttttgttttgttttgttttttcttttagaactgtatagtattgaaaaagaaatcaaatgtaaatgtctggttttcatataatgtttaaaaagaccattgagaaggaggctggcgctcgccccatgtcccccttgattgtaaattgcttctgttctgtttataagtaaactgtgcatgactcctgcttagcggtcattatcgtgtctgttggtgaaatttttattaaaaggaaaattctgtagatgcacttattgaatatgtgattaggatctacgtctgagactaggagtcctgaactgctgacgcgaaagaggcgcagttcccaattaatacggaaatcgctgtgggagaagaatgaaataagacgtgaagtgtaggaaatcatgaaaagaacaattttgcaaattgcattctgatgcttgtgatgaacacaaatgtacttgtgtagagacatttccttaagagaaagcctaggagaagccgatttggaggttaatgctgtagaataggactgtataccaaatgtaatctttccaatgctccaatgaatttatacatgagattgatatgcaataaatctgtgtgcttttct

SEQ ID NO: 23414 - DNA, 8661 bp, Homo sapiens
ctgacaatgctggggagatgaagatagtgtgtggctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcagatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtcccccccatgaatcctgctgtccctgctgccgtttaccagacaatcatatgtttttgttaaatttgcgtttcagttacatttgcatttaagacaagtgttctatttatttcttgtattgtttggaagaaaaaatgatgatagagtcccaaaaagaagagaaaaaaaatgcccaagttgccctttaaaaaaaaagagcgtaaatacaaacaggagtggtgcaagccgccttggtgtgggtttgtgtcacgtgtggacatctcctcaggctttgtgtcacgcgtggacatctcctcaggctgtccccagcggtgacgggaggtgtcctggctgctccaggacaaaagacaatcgtctctgtgggtgccgggtggtccaggcttgcactgaagacgtgccacggggaggctcctgcaggaggctcaacccgacggatcacagtgaaagggattcctcccacgccagatctgcacaacgaggcaagacaggacccacctgtgcgtgcgctggggccatggggtggccccgccggggcagcgggggagctgcctgcagaagagccagctggcgtgtcgggaaggatccaggatctgcaaacacaactgctcaggccttctcacgcgtttccacaacatcccctgggtcagacccaccaggtaccccgtaggaatttccagtttcccttgatctagatgggattcttataaaaattcaacctcagacataaacaccccatttctgtaaacccaaattatatggtttcttctgcgaaagagtaaggtgtgtgcttttttttttttgcaatatgaccccgtctctctgaagtgggacattcggacggatggagccctcagcgtgtcttttcagcaggagcagaaccgatgagagccgcccttaccgttggtctccggatcccccagtcccatcccgccgttttcggctgtcttcctaaccgtcctgtcttctcttggcgctctttccttccacctttcccaagagtcctggttgcacgttttaagtcatatattttcgtccccctgaaaatgatggcaagcccagtttctcctgagcattcagacccccaggccccagcacttggcgttttcaggaggccctgttcttagagcccctgacaaaggcagcacttatttcctgggctggtgcgccccaaaacacggccccgacacttagtgtggccccaggccccagcgagcctcgccctcccagttttgctctgcccagcagtgttggtgcccagagatgacaagggccagggagcctggcccgggtgtgagaattcagagattctggcctccagctgtcaccacaccgtaacggggccatgtaactgtgcagcatggacagggatgcgacggggcagctggctgtgtccatggccaggtggccagggtcagggctgcaagccaggggtccagggcccttccgttcagcccaaatgctgccccaatgctaactccttggattgtcaacccccatcccccaaatggaaattccgaaggaggcctcctcgcacctgccctccgctgctcctcagaccccagcccccagcgagccgacgtccccacccgttcctgctctcatccccaggttgggcacgtggggttcctcctctgtgggcctggcagacccttcatgagtgggacccaagatatcactgacttcaacccagaggatcgagcccctgcaccctgcctggggccctggggtgtggagcagtggctggggtgggcgtggtgtggcctgagagactgcccagctggagaggccttcctttacaaggccacgcgtgcagctgtcccatccagaccccgactggccaagacctccacgtccccagagtccagccctggaaattccaagggccctggcgtcctctgccttccccgcttccccatgagcgtctgcaaaacacttgcctgaatacatatcacgtattttagactcgaagcctcaaagcactggattgtggtcccctgccccctctgtcccgtccccctgcccaagtgactgaaacctactgagctatattcactgtgctgtcctagggggagggagagcagagctcgcccctgcactgcagccttgtgggggagggcaaggctctcctcccagccagggacgccaggacatagctgctcctggtcagtggaggtcagccgggtatcaaaagccatgaaactgtgtctctgtagcaatgagtgatactgtgacaaaaccatccttgcattcttcctagaagagttcctctgctccttccattccatttttgtgtttgttttgttcttttctgtcactgatccgtattaccacttttggaaaaaaataaataaataaataaataaaaggcagcttgagtttccaaacgtgtgattcacttgtgaacaaaagtcattctaacaattgccttcagcgtcacgtgcattgccactgcgctttcggcacgagggatgctgagccctggtgtcagagtcgtaatttaaagcgtgtgtgtatatggactttgtcccttaaggtcgatataaagaatcctcgcagaatcacagacctgtgccgcccgccaccttctgccattgttacattacagatttggtttagttttgttttgttttgttttttcttttagaactgtatagtattgaaaaagaaatcaaatgtaaatgtctggttttcatataatgtttaaaaagaccattgagaaggaggctggcgctcgccccatgtcccccttgattgtaaattgcttctgttctgtttataagtaaactgtgcatgactcctgcttagcggtcattatcgtgtctgttggtgaaatttttattaaaaggaaaattctgtagatgcacttattgaatatgtgattaggatctacgtctgagactaggagtcctgaactgctgacgcgaaagaggcgcagttcccaattaatacggaaatcgctgtgggagaagaatgaaataagacgtgaagtgtaggaaatcatgaaaagaacaattttgcaaattgcattctgatgcttgtgatgaacacaaatgtacttgtgtagagacatttccttaagagaaagcctaggagaagccgatttggaggttaatgctgtagaataggactgtataccaaatgtaatctttccaatgctccaatgaatttatacatgagattgatatgcaataaatctgtgtgcttttct

SEQ ID NO: 23415 - DNA, 3737 bp, Homo sapiens
atttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtgg

SEQ ID NO: 23416 - DNA, 5447 bp, Homo sapiens
gaagatagtgtgtggctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcagatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagcagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtccccccca

SEQ ID NO: 23417 - DNA, 4210 bp, Homo sapiens
ggctgaggatccggaaacgcgccgcagagggtgcggcccagaggaggccgcgggccgggaagggccgggcgggacgggaaacgttagggcagcggcccccggggtgagggggccgagcggacgggcagggccccgaggcgaactctgcccggatgaggaacaaagcagtggggcaggcgcgtgcgcccccagcgcagctggcaggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattttggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacagga

SEQ ID NO: 23418 - DNA, 640 bp, Homo sapiens
ggggcggggcgcggcggcccggcctgcgggccgcgggcgggctaatccacagcccttgggtggcggtgtcggcagcgcctggggctttcgggtagctgggatgggggctgcgaccttgttgtggttttggtgaccgctcttgtccccactcccccaggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtat

SEQ ID NO: 23419 - DNA, 5330 bp, Homo sapiens
gcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacatgttcttcagtgcacagcgaaaagcagtctaaaggagtcttcgcgaagttttcagtgctctgtttgcaattcttccttcagttcagcatcgagttttgagcagcaccaggagacttgccggggggatgccaggtttgtgtgcaaggctgacagctgtggaaagaggctgaagagcaaggatgccctgaaaagacaccaggaaaatgtccacactggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaagacccactctgaggagagaccgttccaatgtgaagaatgtaaagctttgttccggaccccattttctttacagagacacctgctaatacataacagtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaaacacatacaggagaaaaggagaaaatctgtccatattgtggccagaaatttgccagcagtggtacactcagagttcatatccggagccacacaggtgagcgtccctatcaatgtccttactgtgaaaaaggattcagtaaaaatgatggactgaagatgcacattcgtactcacaccagggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggccatccctctgtaatgaagtttataatatacttccctaataggcctttttattttattgttattctttgtgtgtctgtgtgtctgtgtgtctgtatgtgtctgtgtgtgtgcactcacttgcaaatgccagttgttgcagctggttttaccaatttaaatagaaataaatcaagatatccaactatttctttgcagatgaggataagaataagttatcaaagtctcaagtttgataggaaaataaatagttgctattttataagacaaaccaagagctgagcttatctaatagctctgtgcaacaaatgagtttaaaatagatatttgataactaaaacatctattaaaatattgctcattttagaggattcttaggaaacattatttattctcatcattcagatgcagacattcatggtctggaatacttttataagttctacacaaaaatgaccatcacatttaaatattcagcaggctacccctcttgaatttagaccatttagctttagaaattaacagtataccaatatatataattaaaaatagaaaccaaatagattctctgtatttggcaacagagtggcagaacaatagtggcatctccacatttgttaggatgaacatagccctttcccctctccttccataaaagtgcacagaacatgttagtgcagatacagtcctcagaacattaacattccattttgcaaaagacattttccagaatcttggcagtaggtaattctgaaacacttttgaattaccttcaatcatcccatataattaggaatccagaatacaaagtacaaacttggcaattgttatgattgaaactgtcactgatgcttaagggaaattgaagcaagaagcataatttcttcctttaggttatatttcagcaaaatacttgacagcaacatacaatgaacagcttgtttggagagatgatatgatacaatgtaatagtgatgtcaaaataacctggaggaatatccaaaaaccagaaaaacgttaaaatgaagcccaactcatgaacctctctaactgaagcccagtcaaaagaaaggaagtatagttttaaggaagttatttggttctaatgagttaaggagaaaggttatctgagacacagttctttgacttcaggaatctcattttagaattatattcatgcccagttccagttttaaaaagaaacataaagattcaatgtagacatttgaatgttgtaaaatactaaatttgaaactcagaagagataacttttaaaaacataaatcctaaaattatagtttagaagatatttaagtatagttatatgtagtattttgaatctgaaattatagactgtattttataaaaataaattttggtcttgtttctcactatatcatttgtttcaacaatatatttttagatctaaagtgttttcattttaatatgatagtgtgtttaatatcatttgaatataaaaagacagctgtaaaatttgatagtgtgtattatttaagcacatcctgtatatttctttgaatgctgctttctctatatgggatgctttatatcccgattatgtgatgaatgtaaaacttgaaaggagtccaaattccaattttgtgtaatctcagtgagtcacagttcacatggctgctggggaaattaccctgaaaactgtggtgtcgctatgctgtggagtaaacagacaggcaagaggtgctgggctttatcctgctgaaggtttatagacatggaaatctttagaaaatggtgtagaaggacctacaccagagagtggtacaccactctctcctttcagaggactgaaaccaaaacaagtccttagtagactatttgtatgctgtaaatttttatccaaaagacaagtattcatgggtagtttcagatatattagcatttgcttgctaaaacttttaaattacttagtaataaccaaaaaaagacactattttaggcatgattgatcaattgaaagcatagataatcataaggaaaagtcttacagacaagctgaagtacaggtacctactttgaaatgtcttctgtttcctgctgtgaaagattttggctggggtattttcttgagaaaagaccagacccttaggtgcctataaagtctaagtaattgagacttagaaattggctaagtaaatttaagagacgttcaataatgtaggtgggttcagatacccttttataataactgtcttcttagtatattaacactcaagatgtttgtgtatctttaatttgcctttgtttcacaataactggcttttgttttccttttcatggtgtgttgttggctatatagaggcatttattggtaaattataatcagcagttgcaccatggaagtattcttggtgataaattcttggggttacatagtatagttaacatgttattttcaagaaacatgagtgtgtgtgtctgtgtgtgtgtgtctgaagagtatcacttatatgcagtgcatatacatgtaagtgcattactttgctcaaatatcttctgacctattacagtcaactcatgcatgagtgtgaacatgtattacagaaggtcttacagccttagtttctgttttagattttatgtgctgcttcctttctcaaacaaaagcatgaaaggaaagaggataagtactagaaatattcatttttttccttcacaaatctaaatgttgcttatgaaaactcatcttagagtaatgaatatgtggaagtgggtaggtaggaggaaatgtgcctctttaaaatcctaaaattttaccattgatattgacatttgtttgcgtgtatataaatggagcatgtgtaaatatagaattccaatagcattttttattttattataaatctataataaatatatataaatcactacca

SEQ ID NO: 23420 - DNA, 2492 bp, Homo sapiens
gcgcccaggcccgcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagacaagaatttgggacccgccgaatggcgaggctaaaagagctgtaacacagacaagactgagacctgctccttgcttgccacattgcgagtgaagagaaggagagaagagctgcagcctttcagggatcccagacctgggagctccccaagccagggctgtgactccttctttggggtgctgcagttcctggtgtctccgagcttctggatgccactgtgttccctggtgtcagctgtggaagctacttgcggtgtgcctgtcccagctgcagcctggcagagagctggcacctgtgctggcacctggagctgcccacccttctgcagcagccggcatatctgactgtgcattggccagaccccacactcactctcacaccccttgccgctccatgcagtctcccttggcaggtgtggaatccaggccattagtgtgagctgaacacagcctgccaggtcgagtgagcagaatgagctcagtgggctgaagcaaaaatttgggcaaaggcacgactggccacagaggtttccagccagaaaagcaacaccccaaagatcccataataataggagtgcaaaacctgttgtaaactgtgcatgccagggatctaggttgtgtgttccttatgagaatctagctaatgcctggtgatctgaggtggaacagttttatcccaaaaccatccccagccccatccctgtccatggaaaaactgtcttccacaaaacctgttcctgatgccaaaaaggttgggcactgctattctataccgctgtaggatgactatagttaacaataatatatagtttcaaaaagctagaaggaagacattgaatgttcccaacacaaagaaatgatacatgtttgagatgatggatatgctgattatcttgatctgatcactatacatgatatgtattgtaacatcactaggtaccccatgaatatgtacaattatgtgtcaagataaataagtaataaaataaaaagctttatcttattccccaaaaaaagacagcttgaggaaaggaaaaaggaagattactagcagagttgtaggctattgtctatggtactttactgcatgaagaaggtacagaggctgaatggaagaggggttgtaaaactggagtatgggctttcctttcacatggagctttgtttaacagaagtctagaaagtagatataagaatcattatcatggttagtttatgtcaaaactatacatactgtcttattatacttaattaaatgggtaatcatttgactagtgtgtctatgagttcgtaagttggtacttaatggttatattatttaattcacctcagtggacagagattaaaacagagtcattttctggttccttttcctgtggttaattaagtcctttgagatatggctgtatacactttatggtggtttacacatgtctgttttattagttttgcagacagtagacaggaacaaaaaggggcatagtcattcttgctgtgagttaaccctacacttctccaagcagtagaatgtaaactcaactaggcttttgagaactttccctcagtgacttaattaattccatgcccatttctggactttggaatatagcatgcatctatgtagcttgttttttactttatcaaatttaaaatgctcattatcgaacatttatatttttatattaaacttttgtaagtataacctgcttggtttcaaatatttcacatgcaacatgacattggttggaataatgttatgttgtatgtaaaagtgtaagttgtatgtaaaagattaatatcacaatcctttgaaatactttgcaccttgctattgaataaagttgatgacttttaattctgttgacataatctagaacccatagggaaactctatgataatgttttacttctagaaagtcagtcaataagt

SEQ ID NO: 23421 - DNA, 2338 bp, Homo sapiens
gcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacattttgagcagcaccaggagacttgccggggggatgccaggtttgtgtgcaaggctgacagctgtggaaagaggctgaagagcaaggatgccctgaaaagacaccaggaaaatgtccacactggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaagacccactctgaggagagaccgttccaatgtgaagaatgtaaagctttgttccggaccccattttctttacagagacacctgctaatacataacagtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaaacacatacaggagaaaaggagaaaatctgtccatattgtggccagaaatttgccagcagtggtacactcagagttcatatccggagccacacaggtgagcgtccctatcaatgtccttactgtgaaaaaggattcagtaaaaatgatggactgaagatgcacattcgtactcacaccagggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggcc

SEQ ID NO: 23422 - DNA, 2259 bp, Homo sapiens
caggcccgcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacattttgagcagcaccaggagacttgccggggggatgccaggtttgtgtgcaaggctgacagctgtggaaagaggctgaagagcaaggatgccctgaaaagacaccaggaaaatgtccacactggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaagacccactctgaggagagaccgttccaatgtgaagaatgtaaagctttgttccggaccccattttctttacagagacacctgctaatacataacagtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaaacacatacaggagaaaaggagaaaatctgtccatattgtggccagaaatttgccagcagtggtacactcagagttcatatccggagccacacaggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggcc

SEQ ID NO: 23423 - DNA, 2027 bp, Homo sapiens
ctctgagagaacgcccggccagggtgaacgccgcggcaggagagcacgggagattgtgaagagcatggggagcctttgtcgtgcagcgtgaaacccttgagcctttggcctaggagctgggagactcagggcccttctcacactcagaattggagcagggccttctagacagtcccagcaccatgagccctgaaaagtcccaagaggagagcccagaagaagacacagagagaacagagcggaagcccatggtcaaagatgccttcaaagacatttccatatacttcaccaaggaagaatgggcagagatgggagactgggagaaaactcgctataggaatgtgaaaaggaactataatgcactgattactataggtctcagagccactcgaccagctttcatgtgtcaccgaaggcaggccatcaaactccaggtggatgacacagaagattctgatgaagaatggacccctaggcagcaagtcaaacctccttggatggccttaagagtggaacagcgtaaacaccagaagggaatgcccaaggcgtcattcagtaatgaatctagtttgaaagaattgtcaagaacagcaaatttactgaatgcaagtggctcagagcaggctcagaaaccagtgtccccttctggagaagcaagtacctctggacagcactcaagactaaaactggaactcaggaagaaggagactgaaagaaagatgtatagcctgcgagaaagaaagggtcatgcatacaaagaggtcagcgagccgcaggatgatgattacctctattgtgagatgtgtcagaacttcttcattgacagctgtgctgcccatgggccccctacatttgtaaaggacagtgcagtggacaaggggcaccccaaccgttcagccctcagtctgcccccagggctgagaattgggccatcaggcatccctcaggctgggcttggagtatggaatgaggcatctgatctgccgctgggtctgcactttggcccttatgagggccgaattacagaagacgaagaggcagccaacaatggatactcctggctgatcaccaaggggagaaactgctatgagtatgtggatggaaaagataaatcctgggccaactggatgaggtatgtgaactgtgcccgggatgatgaagagcagaacctggtggccttccagtaccacaggcagatcttctatagaacctgccgagtcattaggccaggctgtgaactgctggtctggtatggggatgaatacggccaggaactgggcatcaagtggggcagcaagtggaagaaagagctcatggcagggagagaaccaaagccagagatccatccatgtccctcatgctgtctggccttttcaagtcagaaatttctcagtcaacatgtagaacgcaatcactcctctcagaacttcccaggaccatctgcaagaaaactcctccaaccagagaatccctgcccaggggatcagaatcaggagcagcaatatccagatccacacagccgtaatgacaaaaccaaaggtcaagagatcaaagaaaggtccaaactcttgaataaaaggacatggcagagggagatttcaagggccttttctagcccacccaaaggacaaatggggagctgtagagtgggaaaaagaataatggaagaagagtccagaacaggccagaaagtgaatccagggaacacaggcaaattatttgtgggggtaggaatctcaagaattgcaaaagtcaagtatggagagtgtggacaaggtttcagtgttaaatcagatgttattacacaccaaaggacacatacaggggagaagccctatgtctgcagggagtgtgggcggggctttagctggcagtcagtcctcctcactcaccagaggacacacacaggggagaagccctatgtctgcagggagtgtgggcggggctttagccggcagtcagtcctcctcactcaccagaggacacacacaggggagaagccctacgtctgcagggaggatgagtaa

SEQ ID NO: 23424 - DNA, 3691 bp, Homo sapiens
ctctgagagaacgcccggccagggtgaacgccgcggcaggagagcacgggagattgtgaagagcatggggagcctttgtcgtgcagcgtgaaacccttgagcctttggcctaggagctgggagactcagggcccttctcacactcagaattggagcagggccttctagacagtcccagcaccatgagccctgaaaagtcccaagaggagagcccagaagaagacacagagagaacagagcggaagcccatggtcaaagatgccttcaaagacatttccatatacttcaccaaggaagaatgggcagagatgggagactgggagaaaactcgctataggaatgtgaaaaggaactataatgcactgattactataggtctcagagccactcgaccagctttcatgtgtcaccgaaggcaggccatcaaactccaggtggatgacacagaagattctgatgaagaatggacccctaggcagcaagtcaaacctccttggatggccttaagagtggaacagcgtaaacaccagaagggaatgcccaaggcgtcattcagtaatgaatctagtttgaaagaattgtcaagaacagcaaatttactgaatgcaagtggctcagagcaggctcagaaaccagtgtccccttctggagaagcaagtacctctggacagcactcaagactaaaactggaactcaggaagaaggagactgaaagaaagatgtatagcctgcgagaaagaaagggtcatgcatacaaagaggtcagcgagccgcaggatgatgattacctctattgtgagatgtgtcagaacttcttcattgacagctgtgctgcccatgggccccctacatttgtaaaggacagtgcagtggacaaggggcaccccaaccgttcagccctcagtctgcccccagggctgagaattgggccatcaggcatccctcaggctgggcttggagtatggaatgaggcatctgatctgccgctgggtctgcactttggcccttatgagggccgaattacagaagacgaagaggcagccaacaatggatactcctggctgatcaccaaggggagaaactgctatgagtatgtggatggaaaagataaatcctgggccaactggatgaggtatgtgaactgtgcccgggatgatgaagagcagaacctggtggccttccagtaccacaggcagatcttctatagaacctgccgagtcattaggccaggctgtgaactgctggtctggtatggggatgaatacggccaggaactgggcatcaagtggggcagcaagtggaagaaagagctcatggcagggagagaaccaaagccagagatccatccatgtccctcatgctgtctggccttttcaagtcagaaatttctcagtcaacatgtagaacgcaatcactcctctcagaacttcccaggaccatctgcaagaaaactcctccaaccagagaatccctgcccaggggatcagaatcaggagcagcaatatccagatccacacagccgtaatgacaaaaccaaaggtcaagagatcaaagaaaggtccaaactcttgaataaaaggacatggcagagggagatttcaagggccttttctagcccacccaaaggacaaatggggagctgtagagtgggaaaaagaataatggaagaagagtccagaacaggccagaaagtgaatccagggaacacaggcaaattatttgtgggggtaggaatctcaagaattgcaaaagtcaagtatggagagtgtggacaaggtttcagtgttaaatcagatgttattacacaccaaaggacacatacaggggagaagctctacgtctgcagggagtgtgggcggggctttagctggaagtcacacctcctcattcaccagaggatacacacaggggagaagccctatgtctgcagggagtgtgggcggggctttagctggcagtcagtcctcctcactcaccagaggacacacacaggggagaagccctatgtctgcagggagtgtgggcggggctttagccggcagtcagtcctcctcactcaccagaggagacacacaggggagaagccctatgtctgcagggagtgtgggcggggctttagccggcagtcagtcctcctcactcaccagaggagacacacaggggagaagccctatgtctgcagggagtgtgggcggggctttagctggcagtcagtcctcctcactcaccagaggacacacacaggggagaagccctatgtctgcagggagtgtgggcggggctttagctggcagtcagtcctcctcactcaccagaggacacacacaggggagaagccctatgtctgcagggagtgtgggcggggctttagcaataagtcacacctcctcagacaccagaggacacacacaggggagaagccctatgtctgcagggagtgtgggcggggctttcgcgataagtcacacctcctcagacaccagaggacacacacaggggagaagccctatgtctgcagggagtgtgggcggggctttagagataagtcaaacctcctcagtcaccagaggacacacacaggggagaagccctatgtctgcagggagtgtgggcggggctttagcaataagtcacacctcctcagacaccagaggacacacacaggggagaagccctatgtctgcagggagtgtgggcggggctttcgcaataagtcacacctcctcagacaccagaggacacacacaggggagaagccctacgtctgcagggagtgtgggcggggctttagcgataggtcaagcctctgctatcaccagaggacacacacaggggagaagccctacgtctgcagggaggatgagtaagtcattagtaataaaacctcatctcaatagccacaaaaagacaaatgtggtcaccacacacttgcacaccccagctgtgaggtggcttcagcggaagtctgctgaccccttatattccccgagagtataaagagatcggaaataactgattaaacaaatccgccactttcatgactagagatgaggaagaacaagggatagttctgtaagtgttcgggggacatcagcatgtgtggttctttcccgcactgatcccctccattttttgtttgtttttttgcctcctgttctaataaattttgtctccatacaaatctgaaccccaagtgtgtacctcattcttcccttatcactgaaggcaagaagagtccagaagggccacagagaactcatgtgttcagctcaagactccacaggaattcaacccccagaaagacataaacttggagtccgtctggtttaattattggagaatcgattcccaagtccaggaagagaaatgtaagattctagaaagtcgcagcaggaaagggagttccctggtctcctgggaagtgtggcttcttctcctaatggacacctctcctctgctgccatactctcccttggctccccagtctcctctcctgatctcctccaatctctgtagcccaagatgtgaaagccagacaagaacacgcgtgtgtgtatatatgtgttcgggtgtgggggtatgtgccctccgtgtaggtaactgtgtgagtgtggggggtttcaagggtgtgttaggaacaacgctcaaaatcctaaggaaactgaacactcgaacgaaggattcttagcaa

SEQ ID NO: 23425 - DNA, 558 bp, Homo sapiens
aacttacaccacagttaaaggaacaccaaccctcccagatgagaatcagtgcaagaactctggcaattcaaaaagacacagtgtccccttggaagacccaggcctgcggagggacgtgaggagcagccccgacgcccgactcagtcgcaaacaccggagttggggaaaaccaagagcctttggcctaggagctgggagactcagggcccttctcacactcagaattggagcagggccttctagacagtcccagcaccatgagccctgaaaagtcccaagaggagagcccagaagaagacacagagagaacagagcggaagcccatggtcaaagatgccttcaaagacatttccatatacttcaccaaggaagaatgggcagagatgggagactgggagaaaactcgctataggaatgtgaaaaggaactataatgcactgattactataggtctcagagccactcgaccagctttcatgtgtcaccgaaggcaggccatcaaactccaggtggatgacacagaagattctgatgaagaatggacccctaggcagcaag

SEQ ID NO: 23426 - DNA, 1332 bp, Homo sapiens
tcccggtgtgccccgcggtggcgaggggcgtaacggttgttgtagtccggccccctcctggctggtccagccacattaaccggcaggatgtcggaggtgcggctgccaccgctacgcgccctggacgactttgttctggggtcggcgcgtctggcggctccggatccatgcgacccgcagcgatggtgccaccgcgtcatcaacaacctcctctactaccaaaccaactaccttctctgcttcggcatcggcctcgctctcgccgggtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttctgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccataattgggacccagagccctttcccagcacttaaaacaggagcctagagccccctgcccaaacaaaacaggacatctgtgaccgccctacccccacgccagccccaaactaagatatccctcacacccagcccccattacctagggacaagagtcttccccagccttgaacctaggaccaagagccacctacatccagccccaaaactggggcttcaggccagagcatccatggccaatttcaaattgtgaacccagagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgtggatggagtcgggtatcctgactgttggacccctggtccaggtgatcccgaccctcaccagtcccatttgcctccctccagctctgcttaggcattttgcccctcaccccaatgttccacaccatcgacaaccaaggggtgaggtggggacaggcctcagcagggaatggggcgtatatgttagtgttgctgcaacaataaagcctgttgcatctctcatgcc

SEQ ID NO: 23427 - DNA, 1080 bp, Homo sapiens
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagc

SEQ ID NO: 23428 - DNA, 880 bp, Homo sapiens
gtgggccatggccggtacatggctgctacttctcctggcccttgggtgtccagccctacccacaggtcctgtttccttcccttcctcaccagaggctgccacaacagggtgtgggcggcacaccctttccttctctggccccaccaatcatgctgctggtggatggaaagcagcagatggtggtggtctgcctggtccttgatgttgcaccccctggccttgacagccccaggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagcaaatgaaaaatatttgaattcatgtctatcctgggaggaaggaatttggcagagttagaagtaggaaaaatccaggaaagctcccttgaggaagagggcttcctgagacagaacttgggaactgcagagtgggactggtggctgggaaggcggctgtctcctcccccaacagcaagcggggaggccccctcttctcctcaccctggcccaacctctgtgagaggtcagggcagagagcccaggaacccaggaaggtgggtggtgggtctgatgtgaactctcgtacagaggtgaacagggccagggtttctggggaacaggatcg

SEQ ID NO: 23429 - DNA, 1005 bp, Homo sapiens
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggtcctgtttccttcccttcctcaccagaggctgccacaacaggccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagc

SEQ ID NO: 23430 - DNA, 759 bp, Homo sapiens
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagc

SEQ ID NO: 23431 - DNA, 755 bp, Homo sapiens
agaaagtctgggatggtagtggccaggaacggggtgtgccacggccccacctctcagagcagggaggaggatgctgggccagcccttggggaccccaggcaccgtggccacaggagtcagagctctgcatgtctgcaccatgtcctgggctcctgtcctgctcatgctgtttgtctactgcacaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcagaggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctga

SEQ ID NO: 23432 - DNA, 610 bp, Homo sapiens
gcatgctctgttgtggtccagtggccttcccagccctgtgccccaaagcacctggagcatatagccttgcagaacttctacttgcctgcctccctgcctctggccatggcctgccggtgcctcagcttccttctgatggggaccttcctgtcagtttcccagacagtcctggcccagctggatgcactgctggtcttcccaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgtaaaatgggttaataatattcaacatgtcaacaaca

SEQ ID NO: 23433 - DNA, 734 bp, Homo sapiens
aatgcatatttgcaaaaggattaagccacagatttaagcgccgggagcccatttctgccttgcaaaggagaccggactgaaaaacctaaagccagctctgatttcttttcgccaagtgggaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcag

SEQ ID NO: 23434 - DNA, 1459 bp, Homo sapiens
atggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtc

SEQ ID NO: 23435 - DNA, 1044 bp, Homo sapiens
atggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggtggatacccttcgccatgttatcagccagacaggaggatacagtga

SEQ ID NO: 23436 - DNA, 6635 bp, Homo sapiens
atcctcccaccatcctctaaagaggcaaagggattttttttttcttttggtcttcttttttcccccttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttacctcactcgaatccctcactccctatgttaacaggcaatccttctctgtttctcttattactctcactacctcttagcaggaatactccacattgccctattcattccaggcctccctgcttcctcttgctcttcctccctggggacagtactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaatccatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttgcaaaaaaaaa

SEQ ID NO: 23437 - DNA, 1818 bp, Homo sapiens
aagacacataggcagagatctaagaatgaattagagttctccagataaaggggatgtaaggggcagaggggagcagactggccgaagaacatttttgttaaaatccttttttttttgttttgaagaaatatgacttttgtcctaaaattccacagcagagcttccagggctatggtagggattaaggtattctacaacagatgaacaagtcttttagggacagcctgaattgaaggaggccaggagtcggaactgcccctcattgttctttttggtgactaggatacaaagttctgttcggcacagagtactctcctctgcttctacctccgggaaccccgttaccccccagcccacacaccaccaccccagttttgggtggggagaaggcaaagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgtttt

SEQ ID NO: 23438 - DNA, 1538 bp, Homo sapiens
atgctccttgttttctttgtgctctggacttgctcacttgcactgcttgcttcttcccaatcgccgccgcccccctgtgcttcagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttac

SEQ ID NO: 23439 - DNA, 1263 bp, Homo sapiens
atggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtcacctcccccggcacccccggcaagcccactatcacttccgacttccaacgtggcatccgtga

SEQ ID NO: 23440 - DNA, 1459 bp, Homo sapiens
agttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgaaattgcaagaacctattgatggcttggatgctctggtggtgacagcaagtcctcttctcttgactgaagaaatgtcttcccctatctgaaaagtggcctctcttccggaatgacacatactgacttttgaagaagcaaaaggatacctgctggccagtcatatcagccaaaaaactctggtgagcagtgagttggcagatgttgcaactggaagactgtggcatcaacagagccccaaagcaataatctctctttctcttcgcccccactaatccagcaatcaaataatcacttttaagcatttactgtgcaccaccatataacataaaatgtgatgaatagctaggtatatatatgacaacctctaaattctcaaaatattataataaattaagaaagcaagagttgtgcatgtaaaaagacaattaactacatagggagaaggcagtgaacacatttagtgcatctcccctgtaccggtcactgtgtgaggtgctgtacaagtactaatttatctaat

SEQ ID NO: 23441 - DNA, 1020 bp, Homo sapiens
atggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactga

SEQ ID NO: 23442 - DNA, 1674 bp, Homo sapiens
aatgtgggcttggagtcacattcagagcctctgaggcagaggggtgcctgcggtctgttcccagggagccgggcctagggtctgttcctgggaaggatctgttccgtggggcccgctggagccgcgttttcaatatgcaaagtgccggtgctgtgcagacctcggtggtggtggttttgcatgcagaagtgaaattcagaaggccgcgtgtgagcacgtggttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttac

SEQ ID NO: 23443 - DNA, 1804 bp, Homo sapiens
agagtactctcctctgcttctacctccgggaaccccgttaccccccagcccacacaccaccaccccagttttgggtggggagaaggcaaagagtgggaagataagaacacatgtagagatgataaaatgtcattggctccaagagacaagcttccgaaatccatggtggttgaagaacatcaaagaggagcaattatttcagtcattagggcagttccacctgttctaattgaacatttttaggatgtagaagatgcatcatacattggtatctattcagaaggtggggacatctgctgtctgtcatgtatctgggagatgtttatctcaacaggaggcaataataatatgttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttac

SEQ ID NO: 23444 - DNA, 3757 bp, Homo sapiens
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtctttttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagttccaaacaggtttctctcctgttccccagccttgccttcatgatgcaggcccaattgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggctgccggaacagcagttggagcctgggtgc

SEQ ID NO: 23445 - DNA, 3210 bp, Homo sapiens
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctaggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttgttggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctggg

SEQ ID NO: 23446 - DNA, 3202 bp, Homo sapiens
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttggtggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttt

SEQ ID NO: 23447 - DNA, 3202 bp, Homo sapiens
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttt

SEQ ID NO: 23448 - DNA, 3211 bp, Homo sapiens
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaactttttttttttttaaagaaagaaaaagaaaccctgggatccatctgttttttttgttgttgttgttgtttttgttgttggtggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctggg

SEQ ID NO: 23449 - DNA, 3210 bp, Homo sapiens
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttggtggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaatcaaaatgcagttttaaataaagaaatttcttttttccctggg

SEQ ID NO: 23450 - DNA, 3210 bp, Homo sapiens
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttgttggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctggg

SEQ ID NO: 23451 - DNA, 2333 bp, Homo sapiens
cacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtattatggaggttgcgggaggagttgtcaggcaaagtgcacgcatctcagctaggtgcagtggtctccaactggtttggcaacaagaggattcgctataagaaaaacatcggaaagttccaagaggaggcaaacatctatgctgtcaagaccgccgtgatcatagcagagagggggccttttggggtgagagggaccgagctgagtcttccctctctgcccccacaaggctctggcggctctttcaatctctcaggatctggagacatgtttctggggatgcctgggctcaacggagattcctattctgcttcccaggtcagatgcccatctcccctgcaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttt

SEQ ID NO: 23452 - DNA, 2333 bp, Homo sapiens
cacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctaggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtattatggaggttgcgggaggagttgtcaggcaaagtgcacgcatctcagctaggtgcagtggtctccaactggtttggcaacaagaggattcgctataagaaaaacatcggaaagttccaagaggaggcaaacatctatgctgtcaagaccgccgtgatcatagcagagagggggccttttggggtgagagggaccgagctgagtcttccctctctgcccccacaaggctctggcggctctttcaatctctcaggatctggagacatgtttctggggatgcctgggctcaacggagattcctattctgcttcccaggtcagatgcccatctcccctgcaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttt

SEQ ID NO: 23453 - DNA, 2258 bp, Homo sapiens
cacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtcagatgcccatctcccctgcaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttt

SEQ ID NO: 23454 - DNA, 2258 bp, Homo sapiens; identical to SEQ ID NO: 23453

SEQ ID NO: 23455 - DNA, 2333 bp, Homo sapiens; identical to SEQ ID NO: 23451

SEQ ID NO: 23456 - DNA, 2333 bp, Homo sapiens; identical to SEQ ID NO: 23451

SEQ ID NO: 23457 - DNA, 2012 bp, Homo sapiens
ggggcggagcagggagggggcctcagggcccccccccagctatggacgaacggctactggggccgccccctccaggcgggggccggggggctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttt

SEQ ID NO: 23458 - DNA, 2012 bp, Homo sapiens; identical to SEQ ID NO: 23457

SEQ ID NO: 23459 - DNA, 2258 bp, Homo sapiens; identical to SEQ ID NO: 23453

SEQ ID NO: 23460 - DNA, 2321 bp, Homo sapiens
cacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtattatggaggttgcgggaggagttgtcaggcaaagtgcacgcatctcagctaggtgcagtggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtcagatgcccatctcccctgcaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttt

SEQ ID NO: 23461 - DNA, 2012 bp, Homo sapiens; identical to SEQ ID NO: 23457

SEQ ID NO: 23462 - DNA, 2258 bp, Homo sapiens
cacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctaggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtcagatgcccatctcccctgcaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttt

SEQ ID NO: 23463 - DNA, 2258 bp, Homo sapiens; identical to SEQ ID NO: 23453

SEQ ID NO: 23464 - DNA, 2012 bp, Homo sapiens
ggggcggagcagggagggggcctcagggcccccccccagctatggacgaacggctactggggccgccccctccaggcgggggccggggggctaggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttt

SEQ ID NO: 23465 - DNA, 2333 bp, Homo sapiens; identical to SEQ ID NO: 23451

SEQ ID NO: 23466 - DNA, 2012 bp, Homo sapiens; identical to SEQ ID NO: 23457

SEQ ID NO: 23467 - DNA, 2012 bp, Homo sapiens; identical to SEQ ID NO: 23457

SEQ ID NO: 23468 - DNA, 2755 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 23469 - DNA, 1063 bp, Homo sapiens
atggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaa

SEQ ID NO: 23470 - DNA, 2902 bp, Homo sapiens
tcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacagagtcttgtaaaggatccaaaagaaagagggagcaaaggttctgacatccagccaactagcgtggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 23471 - DNA, 2502 bp, Homo sapiens
gcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaa

SEQ ID NO: 23472 - DNA, 1035 bp, Homo sapiens
agtagtcatttcggccatggtgcagcgaggtcataagctgagctcagtgaagggagccagaacatgaaatgatgctgagagaacgtctgggagatgagaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacactttt

SEQ ID NO: 23473 - DNA, 1723 bp, Homo sapiens
ctctgcacaggagcggacgcgggagcccctccgcacccgtcccctcccccgggtcgccttcgcctgcccccggggcgaggctccccgcgcgggttcgcgtcgcgtctgcagtggccgaggctgctgcctgccgggcagatgggtccgccttgttccggctgcagctttcgccgccggggcttgctggctgtcgggaactagtcaactggagtttttgttgacttcccacggaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacc

SEQ ID NO: 23474 - DNA, 2202 bp, Homo sapiens
aatgtagggaaagcagggcggagtcctctgcaggctcgggggaggggaggggcgtgaatgcgtggatttctgtggagagtggaaacacggggagtcgaggggagcatgcgcgggcctcagaaagttttgggaaaccgactcctgggagcagggaggaacgcgcgctccagagacaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagc

SEQ ID NO: 23475 - DNA, 2196 bp, Homo sapiens
gttttgcatacagtccctgttgactctagtgccccctgctggccccagacgcgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 23476 - DNA, 2057 bp, Homo sapiens
gagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgta

SEQ ID NO: 23477 - DNA, 567 bp, Homo sapiens
ctcgactctctgggcgacctcactggatctcgtgagattttgccctggaaggactgagaaacggggattggtcagaccaggctgcccagccccccggcccccaccgccgccccccccgccccacgcagcggctagggcgcttagctgagccattgtctcgttctttccttccagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctga

SEQ ID NO: 23478 - DNA, 2179 bp, Homo sapiens
aatgtagggaaagcagggcggagtcctctgcaggctcgggggaggggaggggcgtgaatgcgtggatttctgtggagagtggaaacacggggagtcgaggggagcatgcgcgggcctcagaaagttttgggaaaccgactcctgggagcagggaggaacgcgcgctccagagacaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaa

SEQ ID NO: 23479 - DNA, 740 bp, Homo sapiens
gtacagctcccccgcagccagaagccgggcctgcagcgcctcagcaccgctccgggacaccccacccgcttcccaggcgtgacctgtcaacagcaacttcgcggtgtggtgaactctctgaggaaaaaccccaggaaacactggtgctcaggtttggagccagagatttgcactgaaagggcgggattgagtcgccagttgtcagtttcctcagcagtatttgcggaggttttcacaggaggccgttgcttcgtaaatattatacatgtattcttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggtaagggtgacct

SEQ ID NO: 23480 - DNA, 705 bp, Homo sapiens
cgtggatttctgtggagagtggaaacacggggagtcgaggggagcatgcgcgggcctcagaaagttttgggaaaccgactcctgggagcagggaggaacgcgcgctccagagacaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctca

SEQ ID NO: 23481 - DNA, 1766 bp, Homo sapiens
agacgcaaaagcccacacttccagtggtgtcagagagtatgagctccaggaggctttgatctcactgccccatgggcttgggccattagggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgagg

SEQ ID NO: 23482 - DNA, 891 bp, Homo sapiens
cgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaacgaggccgttgcttcgtaaatattatacatgtattcttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaa

SEQ ID NO: 23483 - DNA, 2223 bp, Homo sapiens
aaaagcaccagtgggtgatcaggcccaggataggaatcatccctaagcagatccttaaatgccaaatataacttcaattttttgtgacggaaaatgtatttgtgcactgtgcctagcatggaaatagagaaaaactgagtctaattgataggcctgattgcatctcgctgaccagaatctctgtacctgagcagcttaggggcaagaaagaacagctgttttcttgaagtgtggaaacattagtaatacttaggaaggggctggccattggagattatgtttgtggtaaaggcctgacctgctgcttgtgaacagccccagtgtggaagaggacacctaaccataaagagaagggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtg

SEQ ID NO: 23484 - DNA, 2758 bp, Homo sapiens
cgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaacgtaagttcgagccctgattcctccgcttccccgcagggtgaccttgggcttgtgcccccggcaccacccctgtcccgggtccctgttttctctctggaaatgggttgaagaccaaagaaaataatgtgcgccacttgggtcaccccgggccgcctgccccggaaaattggccccagttgaggagttgtggctgtaaggatgccttgaaccgaggcggcggtgctcgtggttggagctctccagggtgggtgcgcatttgtaatgcggtggatgctctgggactcggcccctctgaaggtgctgggggttggggacggcccaggcagtggcgtaggcgtcctaggaaggcgggagcagaggcagaaatgtcgctgcaagaccgtagtcagggtccttgaccacaggggtcacttgtgaccaaccacatggtctgttgttcctcctgccccctggttcagcccaggaaacactggtgctcaggtttggagccagagatttgcactgaaagggcgggattgagtcgccagttgtcagtttcctcagcagtatttgcggaggttttcacaggaggccgttgcttcgtaaatattatacatgtattcttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagc

SEQ ID NO: 23485 - DNA, 1352 bp, Homo sapiens
cctatttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaattactacatttgaccacgatctgtgctc

SEQ ID NO: 23486 - DNA, 677 bp, Homo sapiens
agcgagtgggcggtaactcgcaggccggacgtgacgcaaggcgggggctgagctgcgccggccggaaacccagcaggcggcgaagatggcggagaacagcggtcgcgccggcaagagcagcgggagcggcgcggggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcacaacattcgtctcatgggagaagatgagaagccagcagccaaggaaaactcagaaggggctggggctaaggccagctcagctggagtgttggtctcctagggaccaaggcctttgcatttttttctaccctgactcccacttctaatttctctttattgttattattattattttctctgctattgtaatatttttttgttaattaaatgttttggtcagaatctta

SEQ ID NO: 23487 - DNA, 1462 bp, Homo sapiens
acacccccgtgtttatgtcggtccacgggggttgcctgtccctttaattggcatgtaccaagtccttccaggtcacatttcctccctacgtcccagccgtttggactcactggccaaaagtccaagaggacggaatgtggagacagtgttgtatttttgcggggagttctaggccgaccgggagcgagagaacgctcgggggcgaagcgcgccattgcggccctccccgccgcctgcggtagtccagtcccaagatggcggccaccatgaagaaggcggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaatgataattttccttcttcaaatgacatggaaagcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcaatcttttatgtttctatattatttagaatatttgttgttgcaattttcacataagaaaatttaacagttgtgtcatgttgtttctgtctgattttaattgctgtctaatgacggggaaagcacgatgaaaagatgtacaatcctgcatccttgcttatttcacaactaaagctttgtcatagacttcaaaatatatatgtatatattttatttaaatatatgttacatattatatttaaacatacatatttaacattttttacatatctatcaatatcagagatttgggtaaaagaatgggtaatgtttaaacatgtggaggcatgtggagctttatacaaacagggcagaaccacagaagaacgttttagaaaccaagagatgtgcagaaagaaatgtttagtgttttttcgttttaaattttagattttattttagtgctttgtaattaattggggtttatattgataaagatgtggaagttaaacagctatgtatgtaaaagtaaggcttatttcttaaataaaggatgcatttcttccca

SEQ ID NO: 23488 - DNA, 586 bp, Homo sapiens
agtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaa

SEQ ID NO: 23489 - DNA, 478 bp, Homo sapiens
gctcgccgagagacttcctcttcgttaagtcggccttcccaacatggcgcagtctattaacatcacggagctgaatctgccgcagctagaaatgctcaagaaccagctggaccagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaa

SEQ ID NO: 23490 - DNA, 847 bp, Homo sapiens
atatcgtggttgtgtcgtgagaactttaagattttgcagttccttgtaggcaggagtcctgtttgctgctactttacaatactaggcttaagacattttatgaaatgaactcacacaacagtctctgagaggctcaagcccctccttcccttccgggacggaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaa

SEQ ID NO: 23491 - DNA, 2276 bp, Homo sapiens
gagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctggtaagtggatcccagcatcgttggcaatagggttttaggtggagtctatctggcattcagagaagagtcaggaaaacaattgtattcccagcctgtgtcccatgggcacaagcaaatcccaaattctcctcctgaaccctccaaatttgtctaagaacttcgaaaactttaacaaacaggctgatatcttcataatattcccagcctagaccaagcaggaagaacattgatttcattgaaataattgataataatgaagataatgtttttatgatttttatttgaaaatttgctgattctttaaatggtttgttttctacattgatggaatttttctcttttaatctatctacagcttatagcagttcaataaactatacttctgggaaccgtaattgaaacatttacttttgctttctacctgactgccccagaattgggcaactattcatgagaattgatatgtttatggtaatacacatatttgcacaagtacagtaacaatctgctttctttgtaacatgacacatttgaaatcattggttatattaccaatgctttgattcggatgttatattaaaaacatagatagaatgaaccaatatgaactgcaggcaaagtctgaagtcagccttggtttggcttcctattctcaagaggtttgtgaagatttaatctcagattccttataaaaacttagagaaaagaaaattttagaagacagcctacatggtccattgctactcttgctgcacttatgtaaacaatcagaccacatttgaagaaactccacctattttgcaaacaaacttattctactgaaattatcattggtaaaagtagagatgcccatagagggaaaaattatgtggaaaataaaaactgtagtatacct

SEQ ID NO: 23492 - DNA, 1858 bp, Homo sapiens
ggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgctcctccaggaataggacgtcttcctttctttactccaatagagcagcggtgatgtcatttctgtatttcaggaagactggcagacagttgctttgattcttcctcaaagtatttaccatcagctacagtccaaaattgctttttcttcaaggagatttatggaaaagactctgacaaggactctggaatacaagctcctgataacttcaagatcataccactggactaagaactttcaaaattttaatgaacaggctgataccttcatgaaattcaagacaaagaagaaaaaaaactcaattttattggaataaataatcaaaaggataatgttttcataattttctatttgaaaatgtgctgagtctttgaatgttttattctccagatttatgaacttttttccttgaacaattggtaaagtatacttttgtaaacaaaaattgaaacatttgcttttgctgagtgccccagaattgggaaactattcatgagtattcatatgtttatggtaataaagttat

SEQ ID NO: 23493 - DNA, 1882 bp, Homo sapiens
ggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgcttatagcagttcaataaactatacttctgggaaccgtaattgaaacatttacttttgctttctacctgactgccccagaattgggcaactattcatgagaattgatatgtttatggtaatacacatatttgcacaagtacagtaacaatctgctttctttgtaacatgacacatttgaaatcattggttatattaccaatgctttgattcggatgttatattaaaaacatagatagaatgaaccaatatgaactgcaggcaaagtctgaagtcagccttggtttggcttcctattctcaagaggtttgtgaagatttaatctcagattccttataaaaacttagagaaaagaaaattttagaagacagcctacatggtccattgctactcttgctgcacttatgtaaacaatcagaccacatttgaagaaactccacctattttgcaaacaaacttattctactgaaattatcattggtaaaagtagagatgcccatagagggaaaaattatgtggaaaataaaaactgtagtatacctgttatgagactgc

SEQ ID NO: 23494 - DNA, 2047 bp, Homo sapiens
cctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaa

SEQ ID NO: 23495 - DNA, 1903 bp, Homo sapiens
gtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacct

SEQ ID NO: 23496 - DNA, 1243 bp, Homo sapiens
gtctcagcgcagaaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagtggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcagattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcagaaagttgctttgattcttcctcaaagtatttaaaatcagctacagtccaaaattgctttttcttcaaggagatttatggaaaagactatgaaaaggactcttgaatacaagttcctgataacttcaagatcataccactggactaagaactttcaaaattttgatgaacaggctgataccttcatgaaattcaagacaaagaagaaaagaactccatttcattggactaaataacaaaaggataatgttttcataattttttattggaaaatgtgctgattttttgaatgttttatcctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagttt

SEQ ID NO: 23497 - DNA, 1575 bp, Homo sapiens
tgagcttgagaagtgctccttccaccgggaagagtctcagcgcagaaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagcattacttttaaacttctggaacttgcctaccactgcccaagtcatgattgaagcccagccacccaaagtgtccgaggggaaggatgttcttctacttgtccacaatttgccccagaatcttactggctacatctggtacaaagggcaaatcagggacctctaccattacattacatcatatgtagtagacggtcaaataattatatatggaccggcatacagtggacgagaaacagtatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcagattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcaggagatttatggaaaagactatgaaaaggactcttgaatacaagttcctgataacttcaagatcataccactggactaagaactttcaaaattttgatgaacaggctgataccttcatgaaattcaagacaaagaagaaaagaactccatttcattggactaaataacaaaaggataatgttttcataattttttattggaaaatgtgctgattttttgaatgttttatcctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagttta

SEQ ID NO: 23498 - DNA, 1576 bp, Homo sapiens
tcagcgcagaaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagcattacttttaaacttctggaacttgcctaccactgcccaagtcatgattgaagcccagccacccaaagtgtccgaggggaaggatgttcttctacttgtccacaatttgccccagaatcttactggctacatctggtacaaagggcaaatcagggacctctaccattacattacatcatatgtagtagacggtcaaataattatatatggaccggcatacagtggacgagaaacagtatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcagattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcagaaagttgctttgattcttcctcaaagtatttaaaatcagctacagtccaaaattgctttttcttcaaggagatttatggaaaagactatgaaaaggactcttgaatacaagttcctgataacttcaagatcataccactggactaagaactttcaaaattttgatgaacaggctgataccttcatgaaattcaagacaaagaagaaaagaactccatttcattggactaaataacaaaaggataatgttttcataattttttattggaaaatgtgctgattttttgaatgttttatcctccagatttatgaatttttttcttcagcaattggtaaagtatacttttgtaaacaaaaattgaaacatttgcttttgctctctgagtgccccagaattgggaatctattcatgaatattcatatgt

SEQ ID NO: 23499 - DNA, 1163 bp, Homo sapiens
aggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagtggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcagattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcaggagatttatggaaaagactatgaaaaggactcttgaatacaagttcctgataacttcaagatcataccactggactaagaactttcaaaattttgatgaacaggctgataccttcatgaaattcaagacaaagaagaaaagaactccatttcattggactaaataacaaaaggataatgttttcataattttttattggaaaatgtgctgattttttgaatgttttatcctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagttta

SEQ ID NO: 23500 - DNA, 1529 bp, Homo sapiens
ggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagtt

SEQ ID NO: 23501 - DNA, 1555 bp, Homo sapiens
ggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcagtccaaaattgctttttcttcaaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagtt

SEQ ID NO: 23502 - DNA, 1538 bp, Homo sapiens
gcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagtt

SEQ ID NO: 23503 - DNA, 1961 bp, Homo sapiens
tgagagaggaggggacagagaggtgtcctgggcctgaccccgcccatgaacctgagaagtgctcctgccccgggaagaggctcagcgcagaaggaggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcattacttttaaacttctggaacttgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 23504 - DNA, 1678 bp, Homo sapiens
gaggagaacacacaagcagcagagaccatggggcccctctcagcccctccctgcacacagcgcatcacctggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaaccgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 23505 - DNA, 2168 bp, Homo sapiens
agggacctgaaacacagacaaaaggaaaaacaggagggacaaggaggcagaactgagagaggaggggacagagaggtgtcctgggcctgaccccgcccacgagcttgagaaatgctcctgccccgggaggaggctcagcacagaaggaggaaggacagcacagctgacagccgtactcaggaagcttctggatcctaggcttatctccacagaggagaacacacaagcagcagagaccatggggcccctctcagcccctccctgcacacagcgcatcacctggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtaagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaaccgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 23506 - DNA, 1774 bp, Homo sapiens
gagaaatgctcctgccccgggaggaggctcagcacagaaggaggaaggacagcacagctgacagccgtactcaggaagcttctggatcctaggcttatctccacagaggagaacacacaagcagcagagaccatggggcccctctcagcccctccctgcacacagcgcatcacctggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacccaaagctgtccaagccctacatcacaatcaacaacttaaaccccagagagaataaggatgtcttaaccttcacctgtgaacctaagagtaagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaaccgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccac

SEQ ID NO: 23507 - DNA, 1626 bp, Homo sapiens
ccctggagagaggctcagcacagaaggaggaaggacagcacagcctacagccgtgctcaggaagtttctggatcctaggctcagctccacagaggagaacacgcaggcgcagagaccatggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttca

SEQ ID NO: 23508 - DNA, 1766 bp, Homo sapiens
gagaagtgctcctgccctggagagaggctcagcacagaaggaggaaggacagcacagcctacagccgtgctcaggaagtttctggatcctaggctcagctccacagaggagaacacgcaggcgcagagaccatggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgctccttcaggaataggacgtcttcctctccttaatccaatatagcagccgtgaagtcatttctgtatttcaggaagactggcagatggagtttcgctcttgttgcccatgctggagtgcaatggcacaatcttggctcaccgcaacctccgcctcctgtgttcaagtgattctcctgcttcagcctcccgagtactgggattacaggcatgcaccaacacgcccagctaattttgtattttcagtagagacagggtgtcttcatgttggtcaggctggtctcaaactcccgacctcaggtgatccgtacgcctcagcctctcaaagtactgggattacaggcctgagccaccgcacctggcccacacatttttacataccaagagatcctttaatccacccaaaggctgacgttagctgcatctgtaacacaactttttcctcaaatatatggagttttttttaggcttccacttctatacttccctattctcactccctgttttaatttaacatagacatgcaatgctagataatagaattgctctctaccagctgaacatttgggagcctgtgcagtttctggcccttcttgttgcacatagataaatacatccggtgttatagagactcagttgtaaaaatcaataaatgtgctgcctggttaaaatg

SEQ ID NO: 23509 - DNA, 1526 bp, Homo sapiens
ggacagcacagcctacagccgtgctcaggaagtttctggatcctaggctcagctccacagaggagaacacgcaggcgcagagaccatggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgctccttcaggaataggacgtcttcctctccttaatccaatatagcagccgtgaagtcatttctgtatttcaggaagactggcaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttca

SEQ ID NO: 23510 - DNA, 1674 bp, Homo sapiens
ctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcagtaagaa

SEQ ID NO: 23511 - DNA, 1391 bp, Homo sapiens
cctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatg

SEQ ID NO: 23512 - DNA, 1752 bp, Homo sapiens
cagaaggaggcaggacagcactgctgagagctgtgctcaggaagcttctggatcctaggctcatctccacagaggagaacacacagacagcagagaccatggggctcctctcagcccctccctgcacacagcgcatcacctggaaggggctcctgctcacagcatcacttttaaacttctggaacccacccacgactgcccaagtcacgattgaagcccagccaaccaaagtttctgaggggaaggatgttcttctacttgtccacaatttgccccagaatcttactggctacatctggtacaaagggcaaatcagggacctctaccattacattacatcatatgtagtagacggtcaaataattatatatgggcctgcatacagtggacgagaaacaatatattccaatgcatccctgctgatccagaatgtcacccaggaagacgcaggatcctacaccttacacatcataatgggaggtgatgagaatagaggagtaactggacatttcaccttcaccttatatctggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccattcaccctgaatctcctccatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggctctcgccatttcctaagagatacattgtaaaatgtgacagtaatactgattctagcagaataaaacatgtaccacatttgctaata

SEQ ID NO: 23513 - DNA, 1441 bp, Homo sapiens
cagaaggaggcaggacagcactgctgagagctgtgctcaggaagcttctggatcctaggctcatctccacagaggagaacacacagacagcagagaccatggggctcctctcagcccctccctgcacacagcgcatcacctggaaggggctcctgctcacagcatcacttttaaacttctggaacccacccacgactgcccaagtcacgattgaagcccagccaaccaaagtttctgaggggaaggatgttcttctacttgtccacaatttgccccagaatcttactggctacatctggtacaaagggcaaatcagggacctctaccattacattacatcatatgtagtagacggtcaaataattatatatgggcctgcatacagtggacgagaaacaatatattccaatgcatccctgctgatccagaatgtcacccaggaagacgcaggatcctacaccttacacatcataatgggaggtgatgagaatagaggagtaactggacatttcaccttcaccttatatctggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccattcaccctgaatctcctcccgaagctgcccaagccctacatcaccatcaacaacttaaaacccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagttacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctggtaagcggatcccagtatccttggcaatagggatttaggtggagtctatctggccttcagggaagagtcaggaaaacatttttattcccagcctgcgtcc

SEQ ID NO: 23514 - DNA, 1379 bp, Homo sapiens
cagaaggaggcaggacagcactgctgagagctgtgctcaggaagcttctggatcctaggctcatctccacagaggagaacacacagacagcagagaccatggggctcctctcagcccctccctgcacacagcgcatcacctggaaggggctcctgctcacagcatcacttttaaacttctggaacccacccacgactgcccaagtcacgattgaagcccagccaaccaaagtttctgaggggaaggatgttcttctacttgtccacaatttgccccagaatcttactggctacatctggtacaaagggcaaatcagggacctctaccattacattacatcatatgtagtagacggtcaaataattatatatgggcctgcatacagtggacgagaaacaatatattccaatgcatccctgctgatccagaatgtcacccaggaagacgcaggatcctacaccttacacatcataatgggaggtgatgagaatagaggagtaactggacatttcaccttcaccttatatctggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccattcaccctgaatctcctcccgaagctgcccaagccctacatcaccatcaacaacttaaaacccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagttacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgcttatagcagttcaataaactataccgcagtttattga

SEQ ID NO: 23515 - DNA, 2031 bp, Homo sapiens
agaaggaggcaggacagcactgctgagagctgtgctcaggaagcttctggatcctaggctcatctccacagaggagaacacacagacagcagagaccatggggctcctctcagcccctccctgcacacagcgcatcacctggaaggggctcctgctcacagcatcacttttaaacttctggaacccacccacgactgcccaagtcacgattgaagcccagccaaccaaagtttctgaggggaaggatgttcttctacttgtccacaatttgccccagaatcttactggctacatctggtacaaagggcaaatcagggacctctaccattacattacatcatatgtagtagacggtcaaataattatatatgggcctgcatacagtggacgagaaacaatatattccaatgcatccctgctgatccagaatgtcacccaggaagacgcaggatcctacaccttacacatcataatgggaggtgatgagaatagaggagtaactggacatttcaccttcaccttatatctggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccattcaccctgaatctcctcccgaagctgcccaagccctacatcaccatcaacaacttaaaacccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagttacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggctctcgccatttcctaagagatacattgtaaaatgtgacagtaatactgattctagcagaataaaacatgtaccacatttgctaatac

SEQ ID NO: 23516 - DNA, 1610 bp, Homo sapiens
gcactgctgagagctgtgctcaggaagcttctggatcctaggctcatctccacagaggagaacacacagacagcagagaccatggggctcctctcagcccctccctgcacacagcgcatcacctggaaggggctcctgctcacagtggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccattcaccctgaatctcctcccgaagctgcccaagccctacatcaccatcaacaacttaaaacccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagttacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggctctcgccatttcctaagagatacattgtaaaatgtgacagtaatactg

SEQ ID NO: 23517 - DNA, 2073 bp, Homo sapiens
cgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctatggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctccatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtaagtggatcccagcatccttggcagtagggttttatgtggagtctatctggctttcagagaagagtcaggaaaacatttttattcccagcctgtgtcccatgggcacaagcaaatcccaaattctcctcctgaaccctcccaatttgtctctacagactctcttctccttgtttttctgttttcttatggctgaccttgtgtctggcctgaaaaaggtagggagggggctttatcagccctgagccctatgtggtagaagaggcttcagagagggacaagaaggagagtcctcaagatcaagttgcttctcgctgtcaccgacacatccccttctgccacgtcttttttttcttgtacctattccatgagctacaagggacagctgaggctttgaaacaagctcacacttttcccccagatgagaggaggaagccccttgggtgagggaggagcagctcagactctgcttcctgctctgctccgggctcctctggtgactggccctgcctcactcaacctggggtgggactagcgtgtgtgtagaaagggccctggtggcctgtcctgaatttggctaaattgagctgccagttgaagccaagcctcccccgggccaggctgcagggaaataagaagagagggagcctcagggcagactcctgagctgcgtcctggctctgaagtcaccagctgtatgaggctttgggcacagcacgtgggacacagcacggaggacagtgactgatgcagagctggaggaatagggagattcaccgttggggttattcatggcaggaaaggggcagtgccaaaaagtgtgtaattatagagagggtaagactaccagacactttatatatatctaatataagacttaccattaactatttctatgtgtgcaatttagtgttgtgtaaccatcacactatccatttccagaactttttcctcttaccatattaaacctctgtacccaataaacagtaactctcactccttcttcccctaacccttagcacccatcattctactttgtctc

SEQ ID NO: 23518 - DNA, 1705 bp, Homo sapiens
agaaggaggaaggacagcacagctgacagccgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctatggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 23519 - DNA, 1148 bp, Homo sapiens
acagaaggaggaaggacagcacagctgacagccgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatactatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgta

SEQ ID NO: 23520 - DNA, 1389 bp, Homo sapiens
aaggaggaaggacagcacagctgacagccgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctatggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattgg

SEQ ID NO: 23521 - DNA, 1398 bp, Homo sapiens
agaaggaggaaggacagcacagctgacagccgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatactcgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggt

SEQ ID NO: 23522 - DNA, 1508 bp, Homo sapiens
ggggcgcgggcggggggcttggcgctgcggccactgcgcggcacgacgctgcggcacccgctccagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaatgg

SEQ ID NO: 23523 - DNA, 1525 bp, Homo sapiens
atgatctcaataaaaggaatgctctggctgctgggtagagaagaaagcgaggacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctcc

SEQ ID NO: 23524 - DNA, 1455 bp, Homo sapiens
agcagctgtaggcctgggatgtggaggcgtgtatgcggtggcctcgctgggaggcgtccgtctggggacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatgg

SEQ ID NO: 23525 - DNA, 1612 bp, Homo sapiens
agcacacctgtcacgcctggcgcgccccctgcccgcacgcgctcggtccacgcagctcgggacgcgggcggcccaggctgccaggtccccctgctccgcggcgccgagggctgggctgcgtctgcggccgcgtgggtggccgcggtcttggcaggtggctgcgcgcgggggtcgcagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaa

SEQ ID NO: 23526 - DNA, 1939 bp, Homo sapiens
gacttggattgacatagagagctgcaggagggtgacatgatctcaataaaaggaatgctctggctgctgggtagagaagaaagcgagggtgagggattaatggtggagccagagggagcccagtgagtgccgggagcccagggtggcagagctgtggtgcagggttgcagggtcctggagctaggcatggaggctgctttcgggcaagtggccgggtcagcctgtcctcggagaggcggtgaaggcagagactggaaggcagagagccttgccgacctgtggccgaagagctctccgggagacagccaccggtggtgcaaaggccctggggccggcccagccgggccgcagctccgggaggcggcgcgagcgagcagtgggctgggcggtggcggccggcacccgagccggatcccggcgattgccttacaagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagc

SEQ ID NO: 23527 - DNA, 561 bp, Homo sapiens
ctttctccccgctcctggcaggctgcagccgtctcctcccggtgctccctccttccttgagctctctccaccgctgcccactgggggctacagcttcccggctaccctggaagctggaggccgggaccagctcttcagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactgtgaggagggcctgggcaggctgtgggagccggggagggactgagcagtgagtggggctgaaggccaggctgagtgcctgggtcagccaaacccctggcacccccagggtgacgggtggcgagctgtttgaccgcatcatggagcg

SEQ ID NO: 23528 - DNA, 771 bp, Homo sapiens
ggctgaggcctgcctggcagggggtggaggaggaagctgcccttgcccccggcggggcggggagagacccccatcacctctcccctgcccctgcagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcc

SEQ ID NO: 23529 - DNA, 448 bp, Homo sapiens
tctccccgctcctggcaggctgcagccgtctcctcccggtgctccctccttccttgagctctctccaccgctgcccactgggggctacagcttcccggctaccctggaagctggaggccgggaccagctcttcagggtcttctctggcccagcctttgactgaagctggtctggagacaggggcattagagaagtgactcatagatggcctaaagaagcggggccactcaaggacccaggacagagggaagagggccaacccagctggaccacaggcaaaccccattgcctttgagagaaagaagaggacccggtgaaacatgctgctgctgaagaaacacacggaggacatcagcagcgtctacgagatccgcgagaggctcggctcgggtgccttctccgaggtggtgctggcccaggagcggggctccgcacacctcgtggccct

SEQ ID NO: 23530 - DNA, 725 bp, Homo sapiens
ccccgctcctggcaggctgcagccgtctcctcccggtgctccctccttccttgagctctctccaccgctgcccactgggggctacagcttcccggctaccctggaagctggaggccgggaccagctcttcaggtgacaggcctctgtgtctccacagtgggcagaggggagcctgcctggctgatgagcaagcctcgactttgtcatcaaggcagagaaggggcccgggtaaatgaccccggcggcccccacccctgcctggcgtgagagtgggtaggggcttcggacttgaggggactggagcgggaacaaggcaaggctgccccctgcctttgactgaagctggtctggagacaggggcattagagaagtgactcatagatggcctaaagaagcggggccactcaaggacccaggacagagggaagagggccaacccagctggaccacaggcaaaccccattgcctttgagagaaagaagaggacccggtgaaacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctg

SEQ ID NO: 23531 - DNA, 311 bp, Homo sapiens
cggatgtgtggaggcagagaggcagcatccaggcgctggtcgccttcgggacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctct

SEQ ID NO: 23532 - DNA, 326 bp, Homo sapiens
gatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcgggcctcaggggctgtctttcctgcacggctgttgtgtgcttcgctgagtgtgggtggtcctgcttgtgtcatggtcatggccttccagccccctccagttttccccaaaccaataaagaaagatacagc

SEQ ID NO: 23533 - DNA, 754 bp, Homo sapiens
ctggaaagcggccggatgtgtggaggcagagaggcagcatccaggcgctggtcgccttcggggtgcgggggaggacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagg

SEQ ID NO: 23534 - DNA, 1585 bp, Homo sapiens
gacttggattgacatagagagctgcaggagggtgacatgatctcaataaaaggaatgctctggctgctgggtagagaagaaagcgagggtgagggattaatggtggagccagagggagcccagtgagtgccgggagcccagggtggcagagctgtggtgcagggttgcagggtcctggagctaggcatggaggctgctttcgggcaagtggccgggtcagcctgtcctcggagaggcggtgaaggcagagactggaaggcagagagccttgccgacctgtggccgaagagctctccgggagacagccaccggtggtgcaaaggccctggggccggcccagccgggccgcagctccgggaggcggcgcgagcgagcagtgggctgggcggtggcggccggcacccgagccggatcccggcgattgccttacaagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatt

SEQ ID NO: 23535 - DNA, 498 bp, Homo sapiens
ggaggcgcccggcccggccaccgagcggcagcggcggacgaggggcggccccgacccccgcgtgcccgggggccacccgttgcccggacttcacccctccgcggcggctccgggggtcgggcgggggccggcggcctgctgggggaggaggccgcggcgggcgggggaactcacctccgccgttcttgtagcacagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactgtgaggagggcctgggcaggctgtg

SEQ ID NO: 23536 - DNA, 10959 bp, Homo sapiens
gggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtggaaaggggggctcgcccaagaagggtgaagaagcgaagaaagtcgaggcgccgaggctcccaaagctggcagctccgggtggcggtgcaggggcgaagggggggcggggggaaccgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgggcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttctctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgatctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggctttgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagcctcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattatgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattcttctggcctattgtaaaaaagaaaaaaaaaaagaaaaagaagaaagacacaaagaaaataatctaaacaccaaaaactaaacacaattccaatcctttttctgtacctcacgcgcataaatttgctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgcttcag

SEQ ID NO: 23537 - DNA, 2135 bp, Homo sapiens
aacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttccgcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtgg

SEQ ID NO: 23538 - DNA, 2342 bp, Homo sapiens
accaatgtcactcagacttgctttgaccccgactctccacacagggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttctctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgatctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccagg

SEQ ID NO: 23539 - DNA, 4610 bp, Homo sapiens
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggtgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtccgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggtcagtgtgcagctgaaagcctctccagccttcctagcttcccaaaatacaaagggagaagaatcctattgtatctgtggaaatgagagacaaaccttgtcttggacagtgactcctaaaactctggggaatgtgaacttctcagtgagtgcagaggcaatgcagtccttagaactctgtggaaatgaggttgttgaggtccctgagattaaaagaaaagacacagtcatcaaaaccctgttggtggaggctgaaggtattgagcaagaaaagactttcagttctatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccaaacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaacta

SEQ ID NO: 23540 - DNA, 3938 bp, Homo sapiens
atgtctgaatcttatcggagaactacttttccagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggtgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtccgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggctgaaggtattgagcaagaaaagactttcagttctatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccaaacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaact

SEQ ID NO: 23541 - DNA, 1261 bp, Homo sapiens
actgtgtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccgattcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcctctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattcagttggcccca

SEQ ID NO: 23542 - DNA, 3941 bp, Homo sapiens
accatttcctggagcaatgtcacagggtggctccattttccatttgagctcaaatattttgctgcttcctctgtagctgccagacctgctcttgctgctgctcaggtagaacatctgggaggtcccttgctgaccactggaagaagatgagctcgagctattggagtgagacgagcagcagcagctgtggaacccagcagctcccagaggtgctgcagtgccagccccagcattaccactgctaccatcagtcaagccaagcccagcagcctccagaaaaaaatgtagtgtatgagcgagtgaggacctacagtgggcccatgaacaaggtggtgcaggccttggaccccttcaactcacgggaagtgctctcccctctcaaaaccacctcctcctaccaaaatttggtttggagcgaccattctcaggaactccattctccaactttaaaaatatctacatgtgccccaagtactctacatataacccaaaatactgaacaggaacttcattctccaacagtgaaacttactacatatccacagaccactattaggaaatatgtagtacaaaatcctgaacaggaaccactgtctcaattcctaagaggaagccatttcttcccaggaaacaatgttatttatgaaaaaacaataagaaaagtggagaagctaaatactgatcaggggtgccatcctcaggctcaatgccatcatcacattatccaacagccccaggtcatccactctgcacactggcaacaacctgattctagccagcaaatccaagccatcacaggaaataatccaatttctacacatattggaaatgaactgtgccatagtggatcaagccagatttgtgagcaggtgataattcaggatgatggccctgaaaaattggaccccagatattttggagagttgcttgctgatctgagccgtaagaatacggatctatatcactgcttattagaacatttgcagagaattggaggaagcaaacaggactttgagtctacagatgagtcggaagacattgaatcattgattcctaaaggattatcagagtttacaaaacagcaaatacgctacattctgcagatgaggggtatgtctgataagtcactccgactagtgctgtccacatttagcaacatacgggaggagcttggacatcttcaaaatgatatgacatcactggaaaatgacaagatgagacttgagaaagatttatcattcaaagacactcaattaaaagagtacgaagaactcttggcatcagtgagagcaaataatcaccagcagcagcaaggacttcaagactcaagttcaaaatgccaggcattggaagaaaacaatctctctcttcgacatacactatcagacatggaatacagactaaaagaactggaatattgtaaacgtaatttagagcaagagaatcaaaaccttagaatgcaggtttctgagacttgcacaggcccaatgttgcaggctaaaatggatgagattggcaaccactacacggagatggtaaaaaacttgagaatggagaaagatagagagatctgcagactgaggtcccaattaaaccagtaccataaagatgtttcaaagagagaaggaagttgtagtgacttccaatttaagcttcatgaactgacaagcttgctggaagagaaggattccctcataaagcgtcagtcagaggaactctccaagttgcggcaagaaatatattcctctcataaccaaccctccactggtggaaggactactattaccactaaaaagtacaggacacaatatccaatcctaggcctcctatatgatgactacgaatatataccaccaggtagtgaaacacagactattgtgattgagaaaacagaagacaaatacacttgtccatgaatggatccactttaaagtattacaactcaaagccgttttttttttgtgtgtgtgtctctgcattagtactttgttatttttccatcactaaaggccaatcagaatttggaaccatgctgctacccaagaaatctaatggaatgaattagttctgtagatgacaatttcttcacccatttatgagacctaaatcttttccataacactcatgtattcagtataacaacatactaactgaaagagggacctgattgtttaaagtttgattgcagacactgtagaacataactcattatgtttcagataaggtaactcctagatatcaaactaatttgttggggtagagattttacaagtcatgccattagaagattttctctgatattatatgtgcagttcagttacaagatgaaatcatgtttttttaacaaaagagataaaatacaattgaagcaaaaaataacagctagtatataatatatacagtctgtatttgcttttcacagtaggcctgatgactaaaagatatgctttattacacgctattttcacctcttgaaagtcaaaggtgatgattaatttcatttagcagggaagtggaataatatcttttgaaataactaagtccactaaattatacagtatgctattctggttctaagtacatattagtcccttggcaaatctgttctttcaaagcataccttccccaaatgagcctacctacttcttaaaaaacatataacacaatgtggtagtagtaggtgtaaggaaggtaagttttttcatagtggtatgcaaacatatcattgaaatattacatagatataaagacttagggaataaaaatagcagcaacaaatacttgatagatttatcctacttgggagaaatattttgtagcagagtatttagtatacttagaagttgatttagcaattaggctttaatgaccttacaaagtgaacataactgaacacaagtattttttcaatgcaagatgaggatgaaaattttacatttcaacccatctggctaaagttaagacttagcaaaaattaaaatgttgcctttgtccaagtatagattaaggcaacaaacatatttgggtgtgtaatttgaagttttggactgaaatatctttgcaagtatccacataaaattctgtaatgccttataattatattctaataattatgcattatactaagacaccattaagaacagttgaggcactacactaaatcaaaccataaatgaggaaaaaacttttaatgttcttttctagaagtgttcaaataggtcttgatatgaagctaaaagccttatttatattatcttaatatttcggctaaaatgttaagctccataacatgaattgatacaattccaattttatcaatattttgtgatagaaaaatgttaatattattcatgagctatacagtccttacattttttcccttggtgtaggaacaacggaggagtttctcctctgctaactattcatatatgtaactgtaacaaaagtgtactatgttatgcacacattacaaataatataaggggaagttttattagcttagtaggaaattgttattattaaggtttaaaaatgagaacaggtgtgagttttccaaaatacttaaaaataatagtgtcaaaaattcaggggcagttaaggagtcatggatggaactagaggtcactatattaagtgacataagccagaaacagacaaacattgcatgttctcaattatttgcgggatctaaaagtcaaaacaattgaactcatggatatagagagtagaaggatggttactagtggctgggaaaaggggtgtgcgaggggaactggggatgcttaatgtgtacaaaaactatgtagttagaaagtataaataagacctagtatttgatagcacaaccgggtgagtatagtcaataatagcttaattgtacaaataactaagagtataattggattgtttgtaacacaaataaatacttgagtggatggata

SEQ ID NO: 23543 - DNA, 1067 bp, Homo sapiens
accatttcctggagcaatgtcacagggtggctccattttccatttgagctcaaatattttgctgcttcctctgtagctgccagacctgctcttgctgctgctcaggtagaacatctgggaggtcccttgctgaccactggaagaagatgagctcgagctattggagtgagacgagcagcagcagctgtggaacccagcagctcccagaggtgctgcagtgccagccccagcattaccactgctaccatcagtcaagccaagcccagcagcctccagaaaaaaatgtagtgtatgagcgagtgaggacctacagtgggcccatgaacaaggtggtgcaggccttggaccccttcaactcacgggaagtgctctcccctctcaaaaccacctcctcctaccaaaatttggtttggagcgaccattctcaggaactccattctccaactttaaaaatatctacatgtgccccaagtactctacatataacccaaaatactgaacaggaacttcattctccaacagtgaaacttactacatatccacagaccactattaggaaatatgtagtacaaaatcctgaacaggaaccactgtctcaattcctaagaggaagccatttcttcccaggaaacaatgttatttatgaaaaaacaataagaaaagtggagaagctaaatactgatcaggggtgccatcctcaggctcaatgccatcatcacattatccaacagccccaggtcatccactctgcacactggcaacaacctgattctagccagcaaatccaagccatcacaggaaataatccaatttctacacatattggaaatgaactgtgccatagtggatcaagccagatttgtgagcaggtgataattcaggatgatggccctgaaaaattggaccccagatattttggagagttgcttgctgatctgagccgtaagaatacggatctatatcactgcttattagaacatttgcagagaattggaagaaaacaatctctctcttcgacatacactatcagacatggaatacagactaaaagaactggaatattgtaa

SEQ ID NO: 23544 - DNA, 1972 bp, Homo sapiens
gtggctccattttccatttgagctcaaatattttgctgcttcctctgtagctgccagacctgctcttgctgctgctcaggtagaacatctgggaggtcccttgctgaccactggaagaagatgagctcgagctattggagtgagacgagcagcagcagctgtggaacccagcagctcccagaggtgctgcagtgccagccccagcattaccactgctaccatcagtcaagccaagcccagcagcctccagaaaaaaatgtagtgtatgagcgagtgaggacctacagtgggcccatgaacaaggtggtgcaggccttggaccccttcaactcacgggaagtgctctcccctctcaaaaccacctcctcctaccaaaatttggtttggagcgaccattctcaggaactccattctccaactttaaaaatatctacatgtgccccaagtactctacatataacccaaaatactgaacaggaacttcattctccaacagtgaaacttactacatatccacagaccactattaggaaatatgtagtacaaaatcctgaacaggaaccactgtctcaattcctaagaggaagccatttcttcccaggaaacaatgttatttatgaaaaaacaataagaaaagtggagaagctaaatactgatcaggggtgccatcctcaggctcaatgccatcatcacattatccaacagccccaggtcatccactctgcacactggcaacaacctgattctagccagcaaatccaagccatcacaggaaataatccaatttctacacatattggaaatgaactgtgccatagtggatcaagccagatttgtgagcaggtgataattcaggatgatggccctgaaaaattggaccccagatattttggagagttgcttgctgatctgagccgtaagaatacggatctatatcactgcttattagaacatttgcagagaattggaggaagcaaacaggactttgagtctacagatgagtcggaagacattgaatcattgattcctaaaggattatcagagtttacaaaacagcaaatacgctacattctgcagatgaggggtatgtctgataagtcactccgactagtgctgtccacatttagcaacatacgggaggagcttggacatcttcaaaatgatatgacatcactggaaaatgacaagatgagacttgagaaagatttatcattcaaagacactcaattaaaagagtacgaagaactcttggcatcagtgagagcaaataatcaccagcagcagcaaggacttcaagactcaagttcaaaatgccaggcattggaagaaaacaatctctctcttcgacatacactatcagacatggaatacagactaaaagaactggaatattgtaaacgtaatttagagcaagagaatcaaaaccttagaatgcaggtttctgagacttgcacaggcccaatgttgcaggctaaaatggatgagattggcaaccactacacggagatggtaaaaaacttgagaatggagaaagatagagagatctgcagactgaggtcccaattaaaccagtaccataaagatgtttcaaagagagaaggaagttgtagtgacttccaatttaagcttcatgaactgacaagcttgctggaagagaaggattccctcataaagcgtcagtcagaggaactctccaagttgcggcaagaaatatattcctctcataaccaaccctccactggtggaaggactactattaccactaaaaagtacaggacacaatatccaatcctaggcctcctatatgatgactacgaatatataccaccaggtagtgaaacacagactattgtgattgagaaaacagaagacaaatacacttgtgtaagttcacttgggcatttttagccctattttgacgatatatgtacagccttttaaaattgaggtaaaatatcaaatgaactaaaaa

SEQ ID NO: 23545 - DNA, 1425 bp, Homo sapiens
gccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggttcataggcggaagggacttgacttgtctcagataccctatattaatcttgtgaagcatttaacatctgcctgtccaaatgtatgtcgtatatcacggtttcatcacacaaccccagacagtaaaacacacagtggtgaaaaatacaccgatcctttcaaactcggttggagagacttgaaaggtctgtatgaggacattagaaaggaactgcttatatcaacatcagaacttaaggaaatgtctgagtactactttgatgggaaagggaaagcctttcgaccaattattgtggcgctaatggcccgagcatgcaatattcatcataacaactcccgacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtatttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattc

SEQ ID NO: 23546 - DNA, 1626 bp, Homo sapiens
atcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggttcataggcggaagggacttgacttgtctcagataccctatattaatcttgtgaagcatttaacatctgcctgtccaaatgtatgtcgtatatcacggtttcatcacacaaccccagacagtaaaacacacagtggtgaaaaatacaccgatcctttcaaactcggttggagagacttgaaaggtctgtatgaggacattagaaaggaactgcttatatcaacatcagaacttaaggaaatgtctgagtactactttgatgggaaagggaaagcctttcgaccaattattgtggcgctaatggcccgagcatgcaatattcatcataacaactcccgacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattcaaa

SEQ ID NO: 23547 - DNA, 1453 bp, Homo sapiens
atgccagcccatgttcataggcggaagggacttgacttgtctcagataccctatattaatcttgtgaagcatttaacatctgcctgtccaaatgtatgtcgtatatcacggtttcatcacacaaccccagacagtaaaacacacagtggtgaaaaatacaccgatcctttcaaactcggttggagagacttgaaaggtctgtatgaggacattagaaaggaactgcttatatcaacatcagaacttaaggaaatgtctgagtactactttgatgggaaagggaaagcctttcgaccaattattgtggcgctaatggcccgagcatgcaatattcatcataacaactcccgacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattc

SEQ ID NO: 23548 - DNA, 1236 bp, Homo sapiens
atgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaagtcattttcatttaatggacctattgctatatatcagatgggagactgtgagtcagcctggatcttgtctaaacacccaagagcattgtcatgatgtcactcctggaggttgttctattaagcattagtgatttatacttccggataaccagtggcacagatgtactctttacatagctgatgtatttccttatgttaactttgttttcctaaaggcgtaaatatgttgtttaaaatgaagtattttgtttgtacaaatatgctcaatttatgcatataaatctccctttacaccatctatatagtttaataaagatgctattgtcta

SEQ ID NO: 23549 - DNA, 1336 bp, Homo sapiens
aatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagagtcttcaagtacagaagttcaactttctaactttcaacaaatgctactttcaacactc

SEQ ID NO: 23550 - DNA, 3540 bp, Homo sapiens
tgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagaggctcaagaaaaaggaagattggactatgctaagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaattagaagaaaaaaaggtcaagcagttttcacttgtcacgccagaagcacacttgaggctgcagtcgcagaaataattaatgagattcgctcctgtgacctcagcaaatggacaggaaataagtccttattgattggaccgagccagggatggcgccagggcggtggcctgtggtttttcctgctagagaggacaaagcaagttggaagctgcaggtgtcaagagaaatgctctcaataccaaccagggaggattgtctaatcaaaaactagtgaccaatttgtcataatggagagtagttcaatggattgagaaaaatatgttttatttgttggcttgtaattatgtctctggattattattattttttttttagatgtagttttgctcttgttgcccaggctggagtgcaatggtgcagttttgactcactgcaacctccgcctcctgggttcaagtgattctcctgcctcagcctcccgagtagctggaattacaggcacctgccaccacgcctggctaattttgtatttttagtagagatggggtttcactatgttggtcaggctagtctcgaactcctgacctcaggtgatccgcctgcctcggcctcccaaagtgctgggattagaggcttgagccactgcacctggcctcatgtctctggatttataatgcagtatgaatatactttgtgctttatggtttttataatgtctttttggagaaattgccgaaaagttgccaaatacttgaagtaggagattaaaatgttatcaaatgttaaattggttatattaggaatagtctgtttttctttcctgaagatcagtttttttattcaaacacatttcaaagaaccaaattttttttttctttaaggaaaaaggagctttttttcaagtgaaatgtattcatttgtaatactttggtttaaggcatactttaatttttacgagtttcagaaacagaatttttgtactagggaattcattggtgagagtgttcttttaacctcagaatgtcaaattttggtcttgaaccacagacatccaattacagaaagaatataagcaatctcacaggcctgcaatcggacactgtctctgtgtggttcataggagatgatttttgaggtttgcactcatgcaatttgagaacaccgttgacaagaaggctgagtttacataaatgatctagattgaaactcagctacctttcttcctcatgtggtgtaattacagccctatctggagacagcgaatacagcaaacagattttattacctagttcgctcaaacactacatgaagttattttagttaaagccctcccccaaaagttataaaaccattttatcagggcccaacatgtggcatgcaatgaagagaaaatgtaaagctacagaggttaatgtattgtattataaaatattttaagtgtactcaaaatatcataattgtacagtttatgccaccataatttgaggcctatagatttagcttaagagaacactgttctgtttgaaatgctttctgtcactgaaattggcttaattagtaaccatggataagatgctttagatcagactaggttttaatcattaacttccacaaagaagtcatactttgcgttaggtgtgctggttggatgtgcaggaacttcagcaagcagtaggttttactaagcagatggtcgggcactgcagggcaccaggcaggatcctagggcgcctcttattctgcgttagcatctggtttgctgtatgaccttgcacaagtcacttccttctgagcctcaattttctcatctgtacaatgagattcaaaagttgacctgaaagtcaagtgtgaaaaaaaaaaagagattaaacaagataattatgaaattctt

SEQ ID NO: 23551 - DNA, 241 bp, Homo sapiens
gttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagagtcttcaagtacagaagttcaactttctaactttcaacaaatgctactttcaacactct

SEQ ID NO: 23552 - DNA, 1338 bp, Homo sapiens
aatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggctcaagaaaaaggaagattggactatgctaagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaatt

SEQ ID NO: 23553 - DNA, 2959 bp, Homo sapiens
agagcttgtggaggccatggggcgcgtcgtcgcggagctcgtctcctcgctgctggggttgtggctgttgctgtgcagctgcggatgccccgagggcgccgagctgcgtgctccgccagataaaatcgcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggggcggtgtcactgtcctgttctgattctggcctttgggcagtagaaggtggcaataaacttgtttgctcagggcttctgcaggcatccaaaagcaatcttatatctggctcagtaatgtacatcgaggagaaaacaaagaccaagtacacagtattgggattgtgccctctgtgagagaaaaggaagatcctgagccatcaacagatggaacatatgtttggaagatcttttcccaagaaactcttactaaagcacaaattttaaagctctttctgtcctatgattatgctgtgaagaagccatggcttgcatatcctcactataagcccccggagaaatgcccctctatcattctccatgatcgactttattacctcaatggcatagagtgtgcagcaagtgccatggagatgagtgccattgcagcccacaacgctgcactccttgcctatcaccgctggaacgggcacacagacatgattgatcaggatggcttatatgagaaacttaaaactgaactatgaagtgacacactcctttttcccctcctagttccaaatgactatcagtggcaaaaaagaacaaaatctgagcagagatgattttgaaccagatattttgccattatcattgtttaataaaagtaatccctgctggtcataggaaaacacacggttctaattaagtgtgaaggtatagctattgcacttatgccatctccaaaatttcttaagtattctttcactatccattaggagtttttcttaaacttgtctgataataagaatcacctggagttaggaggtggtggttgcagtgagccaatctcaccattgcacttcagcctgagcaacacgagcaaaactccgtctcaaaagtaaataaaaataatcacctggagtttgttaaaccatatggattctcaagctcctctcttgaagattctgattcagtaggtctgggagtggcgcgctggattttgatcaaaattgtagagcattttaaggtgagtacctgagggagaacttaaagacatcttagttggggagtagtccttttgaattttacagctagatataatcttcagtcagataaaatttatgggagctggtgtcttatgcctgactcttagtaatttcataccggtttgaagtacgtgtgcccatgcctaaagccttgactttcagaatgttgtcttttgattcttctgtcttgatttgattaggggtgaaatttagaagtcttagtaatgtaacttgaagatgttaaacaaaaatctcaagtaaaatgaaaagcaaatatgggctactgaattaagaaactggcattctagtattaaatcctcacttcaggagcttttaaaaatactgagacccccccataaccagagattcagattcaaagactgaggataggaccttagcattgtagctatttaaagtttctaatgtgcacccagggttgggaatcaccaatgtgggtgtgaaaatgcctacaaagggttttagtgccttagaagtcctaagaagcccaatctgtatcaaagcagatccattttgcaaggatctttcttttagaactttctcagttctcttagtaagaactttagaagtaatcttgataataagcacagacagcctaacagcagaggcaacttaaataactcctgagcagttggcactagaacagaatacttggaatgacaccaaagttaaccaagtccagcatatgtccaaagagttaagtgtttcatttactgtagcattctgggtgagaaattggttgctgaaatcttaagacagtggtctcaaccttggctgcacattggaatcacctgtagggttttaaagcatccaaatggtaattaacaggcagcaaaacttcagaactagttctgcatctactgtgcaaagatcatgattaactgtcaagacactggtagaacagaacaagcaaaagattaagagttcaaaagtaaatgcaaccaatttaacatgtagtgttattaaaaaattacaaaggcctagaccagcctgggcaacatggtgaaaccccatctctacaaaaaatttttaaaaagttggccaggcatggtaatgcgcgcctgtggtcccagctgctcgggaggctgaggtgggaggatcacttgagccttggaggtcaaggctgcagtgaatcatgatcatgccactgtactccagcctgggcaacagagaccatcttaaaaaaaaaaaa

SEQ ID NO: 23554 - DNA, 5345 bp, Homo sapiens
gaggccagctgcagagcttgtggaggccatggggcgcgtcgtcgcggagctcgtctcctcgctgctggggttgtggctgttgctgtgcagctgcggatgccccgagggcgccgagctgcgtgctccgccagataaaatcgcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggggcggtgtcactgtcctgttctgattctggcctttgggcagtagaaggtggcaataaacttgtttgctcagggcttctgcaggcatccaaaagcaatcttatatctggctcagtaatgtacatcgaggagaaaacaaagaccaagtacacaggaaatccaacaaagatgtatgaagtggtctaccaaattggaactgagactcgttcagacttctatgacatcgtcttggtggccactccgttgaatcgaaaaatgtcgaatattacttttctcaactttgatcctccaattgaggaattccatcaatattatcaacatatagtgacaactttagttaagggggaattgaatacatctatctttagctctagacccatagataaatttggccttaatacagttttaaccactgataattcagatttgttcattaacagtattgggattgtgccctctgtgagagaaaaggaagatcctgagccatcaacagatggaacatatgtttggaagatcttttcccaagaaactcttactaaagcacaaattttaaagctctttctgtcctatgattatgctgtgaagaagccatggcttgcatatcctcactataagcccccggagaaatgcccctctatcattctccatgatcgactttattacctcaatggcatagagtgtgcagcaagtgccatggagatgagtgccattgcagcccacaacgctgcactccttgcctatcaccgctggaacgggcacacagacatgattgatcaggatggcttatatgagaaacttaaaactgaactatgaagtgacacactcctttttcccctcctagttccaaatgactatcagtggcaaaaaagaacaaaatctgagcagagatgattttgaaccagatattttgccattatcattgtttaataaaagtaatccctgctggtcataggaaaacacacggttctaattaagtgtgaaggtatagctattgcacttatgccatctccaaaatttcttaagtattctttcactatccattaggagtttttcttaaacttgtctgataataagaatcacctggagttaggaggtggtggttgcagtgagccaatctcaccattgcacttcagcctgagcaacacgagcaaaactccgtctcaaaagtaaataaaaataatcacctggagtttgttaaaccatatggattctcaagctcctctcttgaagattctgattcagtaggtctgggagtggcgcgctggattttgatcaaaattgtagagcattttaaggtgagtacctgagggagaacttaaagacatcttagttggggagtagtccttttgaattttacagctagatataatcttcagtcagataaaatttatgggagctggtgtcttatgcctgactcttagtaatttcataccggtttgaagtacgtgtgcccatgcctaaagccttgactttcagaatgttgtcttttgattcttctgtcttgatttgattaggggtgaaatttagaagtcttagtaatgtaacttgaagatgttaaacaaaaatctcaagtaaaatgaaaagcaaatatgggctactgaattaagaaactggcattctagtattaaatcctcacttcaggagcttttaaaaatactgagacccccccataaccagagattcagattcaaagactgaggataggaccttagcattgtagctatttaaagtttctaatgtgcacccagggttgggaatcaccaatgtgggtgtgaaaatgcctacaaagggttttagtgccttagaagtcctaagaagcccaatctgtatcaaagcagatccattttgcaaggatctttcttttagaactttctcagttctcttagtaagaactttagaagtaatcttgataataagcacagacagcctaacagcagaggcaacttaaataactcctgagcagttggcactagaacagaatacttggaatgacaccaaagttaaccaagtccagcatatgtccaaagagttaagtgtttcatttactgtagcattctgggtgagaaattggttgctgaaatcttaagacagtggtctcaaccttggctgcacattggaatcacctgtagggttttaaagcatccaaatggtaattaacaggcagcaaaacttcagaactagttctgcatctactgtgcaaagatcatgattaactgtcaagacactggtagaacagaacaagcaaaagattaagagttcaaaagtaaatgcaaccaatttaacatgtagtgttattaaaaaattacaaaggcctagaccagcctgggcaacatggtgaaaccccatctctacaaaaaatttttaaaaagttggccaggcatggtaatgcgcgcctgtggtcccagctgctcgggaggctgaggtgggaggatcacttgagccttggaggtcaaggctgcagtgaatcatgatcatgccactgtactccagcctgggcaacagagaccatcttaaaaaaaaaaaatccttccattgaatagaaacttcaaagtccttcatcagatcatggcattagctactttagcaaaatagtgtaaactttggttctgagtaaaaatgacttcttccctaccacagttgtgaatgttaatatgctgataaaactgccaagatatatttgataggtaggggattaaactcatggtttgtcaaaagagtgtttttttctagttttattcttaacagatatgttgaggtattcatatttgtttccttttgtggttttaatgaagacaatttgtaaagtaatactgttatgtatatgctaaatgttggtaaatactaattaatttccatcatttgtagacttgttttgcaatgggatatatttttacttataataccaatttaggctgggcgcagtggctcacgcctgtaatcccagcactttgggaggccaaggcaaacggatcacgaggtcaggagatcaagaccatcctggccaacatggtgaaaccccatctctactgaatacacaaaaattggctggacatggtggcgcatgtctgtaatcccagctactgtaatctcagctacttgggaggctgaggcaggagaattgcctcaaccgggaggcggaggttgcagtgagccaagatcgcaccactgcactccagcctggcaacagagcgagactctgtctcagaaaaaaaaaacaaaaaccagtttaggctgggtatggtggctcaccagcactttgggaggctgaggcaggtggatctcttgaggtcgggagtttgagaccagcctggccaacatggtgaaaccctgtctttactaaaaatacaaaaattagccaggcatggtggcgtgtgccagtaatcccagctacttgggaggctgaggcgcgagaatcgcttgaaccctggagatggaggttgcagtgagcagagatcgcaccactgcactccagcctgggcaagagtgagactgtgtctcaaaaggaaaaaaaaaaaattaaaaatgttgctggtattacatcaaacctactctggataaattttccagtagggcatctgaaattgctttggcaaaagcaaaacaggttatcaatacaccaaggacatcaagtagttttaatgcaactacagtgttgagtgcttttttactgggagaaaaatcctagcagaacctgctactctgggcgcattaggtagttttatgcaactatagtattaagagttttattggaagaaaaaacactgtcagagcttactgctccagacctttttttttaatagaagagactggtaaaaatgatgcaggggctgaatgaaagccagctctgctccagtggctctctgagttgagcatgcatcagttaccttaagggcttgttaaaacatcgctaggctccaccctgtttattcaataagtttgttatgggatataagaagatgcattttattaagttccccagtgatgctgctgttctactataggaaccacacttgaagaactagttctacaattcagctgtatgttgtaaaggagtcaagtcaatgaaggagttataaagagttgctgaaaaatggagtaacagtgtatgggacttcacatcagttctccttattgattgttagtttgatccctcttgttcttttgttgtaaacattttctataattaggaaatgccatttaagagtgagagaggtatatatctatgagccattgtgtttggtgttttacaagaactttaccatactggtgtgtagtccattctgtacagtttaaaagtgattcacgatttgcaggctttttatcagatcacaaaaaaatcagtctttaagcatttgcttggtaaggtttcttaagattaggtttataatacaaccatctgtaatgtatctctcgtttgagcttgtgggccatacaattcattaactagatgaatacattgtggacagcatcctcactacccctctctactcactcacaaagaaccatgatacactggaatgtttttctctggaatcctctttctactcttgtattaaaatttttccccacttcatgattatattcaaaataaacaactacatcattacttctt

SEQ ID NO: 23555 - DNA, 1820 bp, Homo sapiens
attctcctgcctcagcctcccgagtagctgggactacaggcgcccgccactatgccgagctaaatttttgtatttttagtagagacggggtttcaccgtgttagccaggatggtctcgatctcctgacctcatgatccacccacctcggcctcccaaagtgctgggattacaggcttgagccaccgcgcccggccagcttctgccttcgatgtcttctgaaggaggcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggggcggtgtcactgtcctgttctgattctggcctttgggcagtagaaggtggcaataaacttgtttgctcagggcttctgcaggcatccaaaagcaatcttatatctggctcagtaatgtacatcgaggagaaaacaaagaccaagtacacaggaaatccaacaaagatgtatgaagtggtctaccaaattggaactgagactcgttcagacttctatgacatcgtcttggtggccactccgttgaatcgaaaaatgtcgaatattacttttctcaactttgatcctccaattgaggaattccatcaatattatcaacatatagtgacaactttagttaagggggaattgaatacatctatctttagctctagacccatagataaatttggccttaatacagttttaaccactgataattcagatttgttcattaacagtattgggattgtgccctctgtgagagaaaaggaagatcctgagccatcaacagatggaacatatgtttggaagatcttttcccaagaaactcttactaaagcacaaattttaaagctctttctgtcctatgattatgctgtgaagaagccatggcttgcatatcctcactataagcccccggagaaatgcccctctatcattctccatgatcgactttattacctcaatggcatagagtgtgcagcaagtgccatggagatgagtgccattgcagcccacaacgctgcactccttgcctatcaccgctggaacgggcacacagacatgattgatcaggatggcttatatgagaaacttaaaactgaactatgaagtgacacactcctttttcccctcctagttccaaatgactatcagtggcaaaaaagaacaaaatctgagcagagatgattttgaaccagatattttgccattatcattgtttaataaaagtaatccctgctggtcataggaaaacacacggttctaattaagtgtgaaggtatagctattgcacttat

SEQ ID NO: 23556 - DNA, 1873 bp, Homo sapiens
attcacacttcagggcggctttcagctctggtcggaataggactgtgcattcccaggcgtggagagcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggggcggtgtcactgtcctgttctgattctggcctttgggcagtagaaggtggcaataaacttgtttgctcagggcttctgcaggcatccaaaagcaatcttatatctggctcagtaatgtacatcgaggagaaaacaaagaccaagtacacaggaaatccaacaaagatgtatgaagtggtctaccaaattggaactgagactcgttcagacttctatgacatcgtcttggtggccactccgttgaatcgaaaaatgtcgaatattacttttctcaactttgatcctccaattgaggaattccatcaatattatcaacatatagtgacaactttagttaagggggaattgaatacatctatctttagctctagacccatagataaatttggccttaatacagttttaaccactgataattcagatttgttcattaacagtattgggattgtgccctctgtgagagaaaaggaagatcctgagccatcaacagatggaacatatgtttggaagatcttttcccaagaaactcttactaaagcacaaattttaaagctctttctgtcctatgattatgctgtgaagaagccatggcttgcatatcctcactataagcccccggagaaatgcccctctatcattctccatgatcgactttattacctcaatggcatagagtgtgcagcaagtgccatggagatgagtgccattgcagcccacaacgctgcactccttgcctatcaccgctggaacgggcacacagacatgattgatcaggatggcttatatgagaaacttaaaactgaactatgaagtgacacactcctttttcccctcctagttccaaatgactatcagtggcaaaaaagaacaaaatctgagcagagatgattttgaaccagatattttgccattatcattgtttaataaaagtaatccctgctggtcataggaaaacacacggttctaattaagtgtgaaggtatagctattgcacttatgccatctccaaaatttcttaagtattctttcactatccattaggagtttttcttaaacttgtctgataataagaatcacctggagttaggaggtggtggttgcagtgagccaatctcaccattgcacttcagcctgagcaacacgagcaaaactccgtctcaaaagtaaataaaaataatcacctggagtttgttaaaccatatggattctca

SEQ ID NO: 23557 - DNA, 2546 bp, Homo sapiens
ggagagccgagcgccaacccgctagcgcctgaatccggcgtgctgcccgctcgccgcccgccatggcccgcgcagccccgctgctcgccgcgttgaccgcgctcctcgccgccgccgctgctggcggagatgccccgccgggcaaaatcgcggtggttggggctgggattgggggctctgctgtggcccattttctccagcagcactttggacctcgggtgcagatcgacgtgtacgagaagggaaccgtgggtggccgcttggccaccatctcagtcaacaagcagcactatgagagcggggctgcctccttccactccctgagcctgcacatgcaggacttcgtcaagctgctggggctgaggcaccggcgcgaggtggtgggcaggagcgccatcttcggcggggagcacttcatgctggaggagactgactggtacctgctgaacctcttccgcctctggtggcactatggcatcagcttcctgaggctgcagatgtgggtggaggaggtcatggagaagttcatgaggatctataagtaccaggcccacggctatgccttctcgggtgtggaggagctgctctactcactgggggagtccacctttgttaacatgacccagcactctgtggctgagtccctgctgcaggtgggcgtcacgcagcgctttattgatgatgtcgtttctgctgtcctgcgggccagctatggccagtcagcagcgatgcccgcctttgcaggagccatgtcactagccggggcccaaggcagcctgtggtctgtggaaggaggcaataagctggtttgttccggtttgctgaagctcaccaaggccaatgtgatccatgccacagtgacctctgtgaccctgcacagcacagaggggaaagccctgtaccaggtggcgtatgagaatgaggtaggcaacagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggaggcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtcaagactgaactgtgagggctctagggagagcctgggaactttcatcccccactgaagatggatcatcccacagcagcccaggactgaataagccatgctcgcccaccaggcttctttctgacccctcatgtatcaagcatctccaggtgacctactgtctgcctatattaagggtccacacggcggctgctgcttttttttaagggggaaagtaagaaaagagaaggaaatccaagccagtatatttgttttatttattttttttaagaagaaaaaagttcatcttcacaaggtgcttcagacttggtttcttagctagaaaccagaagactacgggagggaatataaggcagagaactatgagtcttattttattactgtttttcactacctactcccacaatggacaatcaattgaggcaacctacaagaaaacatttacaaccagatggttacaaataaagtagaagggaagatcagaaaacctaagaaatgatcatagctcctggttactgtggacttgatggatttgaagtacctagttcagaactccctagtcaccatctccaagcctgtcaacatcactgcatattggaggagatgactgtggtaggacccaaggaagagatgtgtgcctgaatagtcgtcaccatatctccaagcttcctggcaaccagtgggaaaagaaacatgcgaggctgtaggaagagggaagctcttccttggcacctagaggaattagccattctcttccttatgcaaagattgaggaatgcaacaatataaagaagagaagtccccagatggtagagagcagtcatatcttacccctagatgttcatcccagcagaagaaagaagaaggtgttggggtaggattcttcagaggttagcctggtactttctcatcagacactagcttgaagtaagaggagaattatgcttttctttgctttttctacaaacccttaaaaatcacttgttttaaaaagaaagtaaaagcccttttcattcc

SEQ ID NO: 23558 - DNA, 1200 bp, Homo sapiens
gccaggaaggcttgcaggttctgctgtttggttgctgaagggggtcagtgtgtgtatgtgtcatggaggtgggcagggaaggggagggctgtgcgtgggggagaggatatatatgctggtgtggctgagaaagcggaaccgagcctcgcatccatcggagggagccggggactgacagctctcagcacctgcttcctgctcctgcaccatgaaagtcctgctttgtgacctgctgctgctcagtctcttctccagtgtgttcagcagttgtcagagggactgtctcacatgccaggagaagctccacccagccctggacagcttcgacctggaggtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggcaatacttggtcctgagcatgcagtccagccagcgccggcgcaccctgcaccagaatggtaatgtgtagccggaaggggcgctcctcccagctgtaccggccactgcaacccatgagcgtccaggtgatcccccaaacagcatgtgctcagccccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcacccgcctcttgccccttctaggggcaggtgaaaggaataggaaattgaacctggggttttgacttgccactgccataacttgtttgtaaaagagctgttctttttgactgattgttttaaacaacgatttctccattaaacttctactgagcaaatggttaataaa

SEQ ID NO: 23559 - DNA, 554 bp, Homo sapiens
tcagtcctcacagagcctctggaagcacagggaaggcagctgtgggatcctggctgaacagagtccagcacctgcttcctgctcctgcaccatgaaagtcctgctttgtgacctgctgctgctcagtctcttctccagtgtgttcagcagttgtcagagggactgtctcacatgccaggagaagctccacccagccctggacagcttcgacctggaggtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggc

SEQ ID NO: 23560 - DNA, 2590 bp, Homo sapiens
tgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagc

SEQ ID NO: 23561 - DNA, 6078 bp, Homo sapiens
cggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagcactttctgtcctggtattttgtttttgcttttgccacacagtagctcagaatttgaacaaatagccaaaagctggtggttgatgaattatgaactagttgtatcaacacaaagcaagagttggggaaagccatatttaacttggtgagctgtgggagaacctggtggcagaaggagaaccaactgccaaggggaaagagaaggggcctccagcagcgaaggggatacagtgagctaatgatgtcaaggaggagtttcaggttattctcgtcagctccacaaatgggtgctttgtggtctctgcccgcgttacctttcctctcaatgtacctttgtgtgaactgggcagtggaggtgcctgctgcagttaccatggagttcaggctctgggcagctcagtcaggcaaaacacacaaacagccatcagcctgtgtgggctcagggcacctctggacaaaggcttgtggggcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataagaacctaacttcaagagtagtgtgcgagtactgatctgaatttaaattaaaattggcttatattaggcagtcacagacaggaaaaataagagctatgcaaagaaagggggatttaaagtagtaggttctatcatctcaattcatttttttccatgaaatcccttcttccaagattcattccctctctcagacatgtgctagcatgggtattatcattgagaaagcacagctacagcaaagccacctgaatagcaatttgtgattggaagcattcttgagggatccctaatctagagtaatttatttgtgtaaggatcccaaatgtgttgcacctttcatgatacatttcttctctgaagagggtacgtggggtgtgtgtatttaaatccatcctatgtattactgattgtcctgtgtagaaagatggcaattattctgtctctttctccaagtttgagccacatctcagccacattgttagacagtgtacagagaacctatctttcctttttttttttttaaaggacaggattttgctgtgttgcccaggctagacttgaactcctgggctcaagtaatccacctcagcctgagtagctgagactacagcccatcttatttctttaaatcattcatctcaggcagagaacttttccctcaaacattctttttagaattagttcagtcattcctaaaacatccaaatgctagtcttccaccatgaaaaatagattgtcactggaaagaacagtagcaatttccataaggatgtgccttcactcacacgggacaggcggtggttatagagtcgggcaaaaccagcagtagagtatgaccagccaagccaatctgcttaataaaaagatggaagacagtaaggaaggaaagtagccactaagagtctgagtctgactgggctacagaataaagggtatttatggacagaatgtcattacatgcctatgggaataccaatcatatttggaagatttgcagattttttttcagagaggaaagactcaccttcctgtttttggttctcagtaggttcgtgtgtgttcctagaatcacagctctgactccaaatgactcaatttctcaattagaaaaagtagaagctttctaagcaacttggaagaaaacagtcataagtaagcaatttgttgattttactacagaagcaacaactgaagaggcagtgtttttactttcagactccgggattcccattctgtagtctctctgcttttaaaaaccctccttttgcaatagatgcccaaacagatgatgtttattacttgttatttacgtggcctcagacagtgtatgtattctcgatataacttgtagagtgtgaaatataagtttaactaccaaataaggtctcccagggttagatgactgcgggaagcctttgatcccaacccccaaggctttgtatatttgatcatttgtgatctaaccctggaagaaaaagagctcagaaaccactatgaaaaaatttgttcagtgttttctgtgttcccgtaggttctggagtctgaggatgcaaagatgaataagataaattctcagaatgtagttataatctcttgttttctggtatatgccatctttctttaacttctctaaaatattgggtatttgtcaaataaccacttttaacagttaccattactgagggcttatacattggtgttataaaagtgacttgattcagaaatcaatccattcagtaaagtactccttctctaaatttgctgttatgtctataaggaacagtttgacctgcccttctcctcacctcctcacctgccttccaacattgaatttggaaggagacgtgaaaattggacatttggttttgcccttgggctggaaactatcatataatcataagtttgagcctagaagtgatccttgtgatcttctcacctctttaaattcccacaacacaagagattaaaaacagaggtttcagctcttcatagtgcgttgtgaaatggctggccagagtgtaccaacaaagctgtcatcgggctcacagctcagagacatctgcatgtgatcatctgcatagtcctctcctctaacgggaaacacctcagatttgcatataaaaaagcaccctggtgctgaaatgaacccctttcttgaacatcaaagctgtctcccacagccttgggcagcagggtgcctcttagtggatgtgctgggtccaccctgagccctgacatgtggtggcagcattgccagttggtctgtgtgtctgtgtagcagggacgatttcccagaaagcaattttccttttgaaatacgtaattgttgagactaggcagtttcaaagtcagctgcatatagtagcaagtacaggactgtcttgtttttggtgtccttggaggtgctggggtgagggtttcagtgggatcatttactctcacatgttgtctgccttctgcttctgtggacactgctttgtacttaattcagacagactgtgaatacaccttttttataaatacctttcaaattcttggtaagatataattttgatagctgattgcagattttctgtatttgtcagattaataaagactgcatgaatcca

SEQ ID NO: 23562 - DNA, 2856 bp, Homo sapiens
tgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagagcctgtctgcctcctgctgccatcaacctgctgtctatagctcccatggcacccaggctgttcatgccaaagggtgcctgcaggcccacggcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagc

SEQ ID NO: 23563 - DNA, 2776 bp, Homo sapiens
cggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagc

SEQ ID NO: 23564 - DNA, 1249 bp, Homo sapiens
cggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcacttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataa

SEQ ID NO: 23565 - DNA, 3046 bp, Homo sapiens
ggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagc

SEQ ID NO: 23566 - DNA, 591 bp, Homo sapiens
aacggtgagggttctcgggcggggcctgggacaggcagctccggggtccgcggtttcacatcggaaacaaaacagcggctggtctggaaggaacctgagctacgagccgcggcggcagcggggcggcggggaagcgtatgatttaactaacaatggatgacctggtgaaatcctatttcagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggt

SEQ ID NO: 23567 - DNA, 712 bp, Homo sapiens
caacggtgagggttctcgggcggggcctgggacaggcagctccggggtccgcggtttcacatcggaaacaaaacagcggctggtctggaaggaacctgagctacgagccgcggcggcagcggggcggcggggaagcacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtg

SEQ ID NO: 23568 - DNA, 591 bp, Homo sapiens
ggtttcacatcggaaacaaaacagcggctggtctggaaggaacctgagctacgagccgcggcggcagcggggcggcggggaagcgtatgcatacaaatttattagcatgcagactgggagaaccacaagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaag

SEQ ID NO: 23569 - DNA, 754 bp, Homo sapiens
ttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagttctgtttttctttcccttttcagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaata

SEQ ID NO: 23570 - DNA, 612 bp, Homo sapiens
tgaatttggtcagcatagaaaaaggaatgttgagaacattccttaagattactcagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtg

SEQ ID NO: 23571 - DNA, 550 bp, Homo sapiens
aaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcg

SEQ ID NO: 23572 - DNA, 574 bp, Homo sapiens
aaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatattcttctcaccgttgtggtcagctctgctttaggcatattaatccatagtggaggctgggatgggtgagagaattgaggtgacttttccataattcagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgagga

SEQ ID NO: 23573 - DNA, 552 bp, Homo sapiens
aatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtg

SEQ ID NO: 23574 - DNA, 555 bp, Homo sapiens
gagctacgagccgcggcggcagcggggcggcggggaagcgtatattcttctcaccgttgtggtcagctctgctttaggcatattaatccatagtggaggctgggatgggtgagagaattgaggtgacttttccataattcaggcatacaaatttattagcatgcagactgggagaaccacaagcctgggtgacagagcaagactgtgtctcaaaataaagacaggaacaaagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatga

SEQ ID NO: 23575 - DNA, 576 bp, Homo sapiens
atgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctacca

SEQ ID NO: 23576 - DNA, 571 bp, Homo sapiens
aacgacgccagagccggaaatgacgacaacgacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatg

SEQ ID NO: 23577 - DNA, 696 bp, Homo sapiens
gagggttctcgggcggggcctgggacaggcagctccggggtccgcggtttcacatcggaaacaaaacagcggctggtctggaaggaacctgagctacgagccgcggcggcagcggggcggcggggaagcgtatgtgcgtgatggggagtccgggcaagccaggaaggcaccgcggacatgggcggccgcgggcagggcccggccctttgtggccgcccgggccgcgaagccgacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgta

SEQ ID NO: 23578 - DNA, 2201 bp, Homo sapiens
ggggcctgggccggcgccgggtccggccgggcgctcagccagctgcgtaaactccgctggagcgcggcggcagagcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaatcttgga

SEQ ID NO: 23579 - DNA, 2465 bp, Homo sapiens
ccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtgggtgtgaagctcagccctgagggtctctggacagcgatcactcagcctctggacagcgatcactcagcctctggacagacagcgatcactcagcctctggacagcgatcactcagcctctggacagcgatcactcagcctctggacagcgataactcagcctctgtccccgtctgagatgttggcagggactgtcagatttgccaggcattgtttgaagttcttcccagcccagaaacctgcatgtgtagattttggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaa

SEQ ID NO: 23580 - DNA, 2302 bp, Homo sapiens
gcgtggggcggggcctgggccggcgccgggtccggccgggcgctcagccagctgcgtaaactccgctggagcgcggcggcagagcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaa

SEQ ID NO: 23581 - DNA, 1972 bp, Homo sapiens
atgttggcagggactgtcagatttgccaggcattgtttgaagttcttcccagcccagaaacctgcatgtgtagattttggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaatcttgga

SEQ ID NO: 23582 - DNA, 1947 bp, Homo sapiens
aaactccgctggagcgcggcggcagagcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacagga

SEQ ID NO: 23583 - DNA, 627 bp, Homo sapiens
gcgtaaactccgctggagcgcggcggcagagcagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccc

SEQ ID NO: 23584 - DNA, 734 bp, Homo sapiens
aattttatgcagagctcctggtggctctgaagcgccctagggaacagaccaggaacattctcatggtgttagctcacattgggccattagtgctcctttaatgtgagaacaaccgggaggaggaggggatgtggacccaaaactacaagaaagagtgtcctcgaagcctatgtcctaccgccccacgctgctgccaggcccgcaggaagatgacaggcccggcctccactccttctaaggtcgtcgcttagttccgacgtcgggatgaccctgtcatccacgcggcgtgaaggccaccctccccgcgcgcccgggactccaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatg

SEQ ID NO: 23585 - DNA, 1240 bp, Homo sapiens
gggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaagtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 23586 - DNA, 1414 bp, Homo sapiens
ggaagtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcatttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaagcaga

SEQ ID NO: 23587 - DNA, 665 bp, Homo sapiens
ctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttc

SEQ ID NO: 23588 - DNA, 1144 bp, Homo sapiens
ccgggtctcacctggctgaatgtcggcttgttgtgaagccgggagcaccggtccccgtgccggcagaccccgatcttaaagtaaaaagagcagttaaccctggaaaaggtgcaaagacaaaggtgaaccgagggccggggaagctgggcaccccagaaacaccgccccaccacccaggaccccagtaccccggccccgaccccccgagagtccactcccagcgcccgttctcacttgtccttctcagtcccgaatatcgaagctaaatattcagccatttttacccaagccctccaggtctggctgctcttacgtcacttccgttgcttaggagcactgggaagtgtagttcgttgccctctccaggcgcttaccaagcgctcggaaacgccccagggcgcttgcgcgtgggaggcgcgcgccctccccatagactccccggtaggagttcttttaacagcgcatgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttc

SEQ ID NO: 23589 - DNA, 584 bp, Homo sapiens
ggcaatgcgcatgcccagcgccgtatcgcgcacgcgctctctgcggctttccttgacctctgacccgccgaccacgcttgatccccggccgcggggccaggaagtcggagtttgagccccggaggcagagcggctgccatggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 23590 - DNA, 3315 bp, Homo sapiens
catgccagcctcgcgcagcctgcgctgacttccccgagacgcgccgcggtcggcacggagactttctgggctctggatggttcgtgcgctgctcaccctcgcccacccctgacgccgcggaccgcagctcctcagccccgcagccccgcagcccagcagccccgcagcggcgccgaggacagtgcagccgagttgcgtctccctcgcgcgagcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaa

SEQ ID NO: 23591 - DNA, 4080 bp, Homo sapiens
agaccagcctgtgggattacacgagacaggatcgagtccaaacgggtccccagctcggcaaggcgcgccggaaggaatctaacagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactgtaagttaatatgaggttctggttcaaggaaaacttacgttggatctgaaccaatgagcagatattttgatatgtgccactcttgcatatacatctcagtcctaactaaaggttctagtggcatccaggacctttagggaggcatttaataaacacttaataaataacaaaa

SEQ ID NO: 23592 - DNA, 4253 bp, Homo sapiens
acttttgaagatcgccggccccaggcgggctcccggcgctgagcggagacgagtttttctccccgcagaggaggatcctggaaggacgcggagctggggcttgggggatgcagtggcctggacgaggtgactccaacccgggggagcagagtccgtcacgccggcagggaccgagggtctctgcggagctggaggaccttttgtgggatgcctcacggctgctgaggggctgcagcggcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactgtaagttaatatgaggttctggttcaaggaaaacttacgttggatctgaaccaatgagcagatattttgatatgtgccactcttgcatatacatctcagtcctaactaaaggttctagtggcatccaggacctttagggaggcatttaataaacacttaataaataacaaaactacctttctgaatata

SEQ ID NO: 23593 - DNA, 456 bp, Homo sapiens
catgccagcctcgcgcagcctgcgctgacttccccgagacgcgccgcggtcggcacggagactttctgggctctggatgcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactggg

SEQ ID NO: 23594 - DNA, 3584 bp, Homo sapiens
tttttctccccgcagaggaggatcctggaaggacgcggagctggggcttgggggatgcagtggcctggacgaggtgactccaacccgggggagcagagtccgtcacgccggcagggaccgagggtctctgcggagctggaggaccttttgtgggatgcctcacggctgctgaggggctgcagcggccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgt

SEQ ID NO: 23595 - DNA, 693 bp, Homo sapiens
gaggaggggttcgctcgctgcctctgcgtcctgagctcggcctctggctcctggggccggggacgcagagaggggctggagccggtcgacccacggcccagggcgccccctcgcggcctaagcagcggccgccgcctggagcgcagagtttgcggggcccagggggcgccgacgcccgctctgaggcgtctctgctgctgcggcggcggggatggggacgacccaggggaccccctgcagccatcactggcagccccatcaagaattggccggctgagttttcccaaacagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccaga

SEQ ID NO: 23596 - DNA, 585 bp, Homo sapiens
tatttgcatcttagcggcttcactcactgggctcgggagaatggagcgggcgggcggcgcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttca

SEQ ID NO: 23597 - DNA, 3324 bp, Homo sapiens
atgtagtggggacccggtgcttgctgccccaccctgctggggtctcctccggaaatgagtgggtgcgggtgactcgtagggcacccagccctctgttccttcgggagtcctccgctcccgctccgggccgccagcctccttcagacgcagagcgggcgggcggctagtgcgcgccgagggctcaggggccggcgccgcgaggggctgcaggccgcgctcggccgctgtccgggccgcagcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattg

SEQ ID NO: 23598 - DNA, 8305 bp, Homo sapiens
gacttctcaggcaccaccagcagcgccaccgagagttattattattttttgaccaagcagcacatttcctggttcagtggcttgagctctgtgagcagctgactagtcaccccgggtctggctcaggatcagctggtgacgctgggctggagtctatgacttcttccttcagattgtcatgaagaaggggagttaagaggaaactgggggtcctccggaaggcgatctgagcactcaggctgatctagaggaagagtagaagtcatactttttttctcttgcttggtgaattccccagcagagtctggatccagcagtgctgttttccctgagggaatgtggagcagctcggcttgagtctgttgccagcttcaggaagggttcagactgaaaagggggtttgaggagaagatgctttggctgcctgaggtcctgcttgcgttcttagaagtcagatccagggagaaagtgaactgggacaattgacaagctccaagggtctggcagaagcttcctccgagactgggcatttcatcctccctggaggaagatctgcctgcactgcaagtgtccccaggaggagcacatggtgacagtgatgccgctggagatggagaagaccatcagcaaactcatgtttgactttcagaggaactcgacctcagatgatgactcaggctgtgctttggaagagtatgcctgggtcccgccgggtctgaagcctgaacaggtacaccagtactatagctgtctcccagaagagaaagtcccttatgtcaacagtcctggagagaaactgcgaatcaagcagctactacaccagctgccgccacatgacaatgaggttcgatattgcaactccctggatgaggaagagaagagggagctgaagcttttcagcagccagaggaaacgcgaaaacttgggccgcgggaatgtcaggcctttcccagtcaccatgacaggagctatttgtgaacagtgcggaggccagatcaatggtggagacatcgctgtgtttgcgtcacgcgctggccacggcgtttgctggcacccgccgtgcttcgtatgcactgtctgcaatgagctcctggtggatctgatctacttttaccaagatgggaagatatactgtggcaggcaccatgctgagtgcctgaagccgcgctgtgctgcctgcgatgagatcatctttgcagatgaatgcacagaagctgaggggcgacactggcacatgaaacacttttgctgcttcgagtgtgagacagtgctgggcggccagcgctacatcatgaaggagggaagaccctactgttgccactgcttcgagtccttgtatgcagaatattgtgacacctgtgcccaacatataggtatcgaccaaggtcaaatgacctatgatggccaacactggcatgccactgagacctgtttctgctgtgctcactgcaagaaatccctcctggggcggccattcctcccgaagcagggccagatattctgctcacgggcctgcagtgctggggaagaccccaatggttctgactcctctgattccgccttccagaacgccagggccaaggagtcccggcgcagtgccaaaattggcaagaacaagggcaagacggaggagcccatgctgaaccagcacagccagctgcaagtgagttctaaccggctgtcagccgacgtagaccccctgtcactgcagatggacatgctcagcctgtccagccagacacccagcctcaaccgggaccccatctggaggagccgggaagagccctaccattatgggaacaagatggagcagaaccagacccagagccctctgcagctcctcagccagtgcaacatcagaacttcctacagtccaggagggcaaggggctggggcccagcccgaaatgtggggcaagcacttcagcaaccccaaaaggagctcgtcactggccatgacaggacatgctggcagcttcatcaaggaatgccgagaagactattacccggggaggctgagatctcaggagagctacagtgatatgtctagtcagagtttcagtgagacccgaggcagcatccaagtccccaaatatgaggaggaagaggaagaggaagggggcttgtccactcagcagtgtcggacccgtcatcccatcagttccctgaaatacacagaggacatgacgcccacagagcagacccctcggggctccatggaatccctggccctgtctaatgcaacaggcctctctgctgatggtggtgccaagcgccaggagcacctatcccgattttccatgcctgacctcagcaaagactctggaatgaatgtgtctgagaagctgagcaacatgggcactcttaactcgtccatgcagttccggagcgcagagtcagttcgcagcctgctctctgcccagcagtaccaggagatggagggaaacctccaccagctcagcaaccccattggctacagagacctgcagtcccacggaaggatgcatcagagctttgattttgatggagggatggcgggcagcaagctgccagggcaggagggcgtgaggatccagcccatgagtgaacgcacccggagaagagctacttcacgcgacgacaaccgccgtttccgacctcacaggtccaggcgttcccgacgctctcgctccgacaacgccctccacctggccagcgaacgcgaggccatctcccggttaaaagataggccccctctgagagccagggaggactatgaccaatttatgcgccagcggagcttccaggagagcatggggcatgggtcccggagggacctgtacggccagtgccctaggactgtgtcggacctggctttgcagaatgcctttggggaccgctggggaccctacttcgccgagtatgattggtgttccacctgctcctcctcttcagagtctgacaacgagggctatttcctaggagaacccatcccccagccagcgcgcctgcgatacgtcacaagcgatgagctgctgcacaaatacagctcctacggcctccccaaatcttccacattaggtggcagaggacagttgcacagcaggaaaagacagaagagcaaaaactgtatcatttcttaatatgattgggatcagggaatgggagaagatgggagctaagaatgtaaagtcagaaacttgcactgttttaaatgttaaagcgcttttgggggtggcttatgggggagaaaagggaaaatgctgtcagtagatggaggcaaggttacaggttgactcaataggtagtcacagttcttggcatgttgaatattatttgcacatttcactttggaaacacagtagactctatcgaggccaggcttggtcacttccttcccatcagttctgtgttgagttgccatctctcaagatggtaaattgtttcctgctcgcttttatcctctctggttctcttacttttaggacccttttttcagtaagtaatttgtttattagccaggacccaagactaagttatttacatgtccattgtaaatgcaatgtaaatgagagttctgataaaatatttttgtattttgtaatatcaaaggaatttctatatcgtaggactcagtggggacttgcatgcacatccaccattgtctctgagtagtattgaaatgtggcccggtaccaccttttttttttttttttttttttctatacaaatttgttacatgtcagtgagacctttttcaaaggaacatattcaatttggctttttgtggctgaaaaaacataactgttagacccaaagcattttatgctccgttccatcttaaggagccatccttaagtctgctcccaccctcagtagaatttattttctacaaagtggtagtaatttttttttaaattgcaaatgtaatttttgccaattagagaaaccaaccggtgtcagtaaaattctgtgagaaatgccatccctgctgggaatgttgaagttacttaatgttgatctatcccttggggaaagtaaaagtgactgtgagtggtgccattgtgtgatgtcagcatgacgttgttttgaatgtggcattatgttctggtgctcatgtttcctggattgtattatctgctttcctttaccaaggcagacagaactgctgccttagcctgacaaccggttgtcctcaaagcaaatgaacttaagcatttgggattgagggacagaaggattctgagggggctctgcgagggacggtgtgtgacatgtcatgcctggagaaggaacaaggctatttgaaaacagaaggcaggtcaagggtagaagttaaaggagaatctgaaggcaggtcagggaaaagaagaactggaaatgaaacagaggacaggtgacaaccacctcgaagagctcccagagattgtagaaagagtccagtgtaaccagcttagtaaccagagtatctggattacccaggaaggttgagctgctgagatttcagtggtgcaatgtctttaaaaaaacaggctttgttgggagggtatttccattttgaactttgaggactgttggtcagaaaatgggctcaaaagtgagtttgcttaatgaagacatttaacggttgtgctgtttatagtaaaataaaactccctaccttgcttcagttaaaaatgaagcacttggtttcttccatcctcctcctccccttaatggattgtggcagttgaaataatccatcggatgacccacctgtagtgagatgtactgtcgatgtagtgcccggtgtatctcagtggccatctgccatggtgaggtgagcgtgatctcttttcagtatagtagttaacattttctagtattttttatggagagaatgtcaaaagtggcatttcagaccccgtcccagatgggtctgaggaaaggaaggctgtaaaggacatggtaatggcactccattcgggatgtattaaaataatttgcttttcaggtattaatatgacatttgtcattgtcactgatttttttaaaaaagcaatgcacatgttggttgtggctgttttccgcatgctatcttcatatctaaatgcttcattaattatccgagcctccggagaattaactctattacgtttgtatagtaagtttgtaaactgcttggcaaactgattaagaaataatttgcaataccgtgctactaaagtggcaggtttctggtagaaattgtgcgagtccaatttggagttttaagttccttgattgatgaaactaaaaaggcaattttggaaaaagagagggggaaaagtagatcacttatcttagcaaacggttgaaaatatgtctgtcctctgtggccccaaatccagtgaaagaaattctcccagtaaaagttgcttcctaactctgtttttctcagaatacctcttacctttctcaaagaaagcttcaaccaccatcatcagaaagaaggtggcctaaaaactgacacatggccagtgcccggaggggtctggaggcataagtctagatgcccagagagcatccaggcactgaactgctcagagcttgagatgaaatgacatacaagcttcagggtaaaactgtctactagcaagattacctccctcaattctaccattgcagatttcttctgaccccaaatgcaaccttacagagaatgctgaatgaggaaggccaattccttacaatgatggcagaacccccaagcgaatgccctattgaggagaaggacatcactgtatttggaattctgcctgctagtgatagctcacacatcacatcccagaatcccactcccaatgcattatttcctgaggcaagaacttaaggtcctcacctaattcctccatcacaaccattaactcttattggacaagctcctcctgtgagtagggcctgtactcacttcctcttagatcataattccatcttcaagagactgatttccagaatagtaatctttttccagcgttctctcttctccaatgccctggttgttatttttcccacctctcctaatattgatcttcttgtcttttggttagaactgcaacttcggagttgagttcatttcctattgctgctcaattcagtagcaacatagctggcttgttcccagacccaggaagtataagtcattgacagtttcctgagtggctctgccaatccataccacccttggtactgtgaaaaggcttcttggcagccaggtggcattgaggatggtattcagggcgctttccttctgtcatatagttgtgggatctctaccaagtgtgaaggtgaatgaggtaagggagatcagaaccatgcttcctggtttttcatacatccaaggaagaagtcctggtgtgggttgtttgacaccttctttccactttcaccttttattttttattccttcctttctacccccaaccagtcgagcaaatgagcaattttgtgtttctaatacaggatctggaagtagtgctttctaatcctcatttcctgtaggatgttcctgcactataacaagattatgttttcttccttctgcagcagctttctgcttcttgggtactactagctattgttcaattcaggtgaggcctgtgatgacatatatgtagcatgtgctctgcgctccctgcaagctgagcagatacaaccaatgcatcactgtatactcttgctgagaatgtggatgcagcctcacagatctttgcaacactccaaccagccaggaccagttgatcagaactgatcttattggtctgataaccaatcttatttgtgaactgattcatatctgtctttccactcttggttctcttgccgtagaacaaaaacagtttaggaagcataattacgaacatttaggaaccaatatgtataagtaattcggagactccaattcacctgcccctcccccatcccaggttgtggaggctcgaggaagctgacttcttaggctaaaggacaaaaaaatctctttacctccttggccattttcatgttctctgccaattactataggcagtcttcattttgcagaggtgaggtaagacttcatcttattcttcatgtaatcccaccttctaacaaaaaataaataaatatttaaattccaaggagaagtgttctttgtgtatttctagcagaaaacagatgcttaagcctaagaaggaagatccgtccatgacaaaggaaagtggaaaactgaaccagttatctgaatacttcatgccaggacagttgctattagcaactgttttgcaccttcagggctttaaaatgggctctgcagacagcatttgcatatgcaagactcagtagccaagcctccactgccaattgttgaaggcagtttcagatcgccaccttttgaggtacatttctttaagcacaagagaagtagaaatggcctttgccttgtctccagtggtttgtccctctggtgcctcagcagataccagagcttattcttatgaccatttggaagtagtcctcaaagtaaagatcaagaaaaaattggattctttttccattttctcataatagtagcctagtcaacacaagactcccataaaatatgactcactattgggagccatactattttataagcttacttcctgctgacaaaactagctttcctcaaggaaatataaaggaggggaaagtcacatagtgttaggaaaacattcctgtgttttgaatacgatgaatccataggatagagaaaaatctgcttgttctattctgagagttctctgagatatcccttcactctgcttggcatttggccattgatattcaacaggtcactgaccaagcttttctaaatttttcagagagagttacttaccagtaaggtctgttcttaaacctacctagttgattttcatatctttccataaagtgtcatgattctgtcatagaccctgacttaacattgtaaggactatgagtcctccattttttaattaatttttttttagcaaattaggacttcggcaggttttcctctcctaaactcattctttcctccacaggattgctttgtccatctcctgctttcatttcaagtgcataaacaaaacctcaaagggcctgggaaggtgaggcaggccagagtctgtgttctgtgttgagtgtcaagctatttgttaagaaggtctgcaacaggcctttggtgtgggctctgccagagactgttctgaacactttgcttgagatccgtgccctgtaaaatggatatgatgttttactgatgtctgtaatacatttgtaaacttccaataaaatttgaataaaagaaa

SEQ ID NO: 23599 - DNA, 573 bp, Homo sapiens
aaccccctttccccggctcccccgcagtttcccgggccggcagaggcgccgcagcgtcggagcaatgcaaggctaagccgggaagatctgcctgcactgcaagtgtccccaggaggagcacatggtgacagtgatgccgctggagatggagaagaccatcagcaaactcatgtttgactttcagaggaactcgacctcagatgatgactcaggctgtgctttggaagagtatgcctgggtcccgccgggtctgaagcctgaacaggtacaccagtactatagctgtctcccagaagagaaagtcccttatgtcaacagtcctggagagaaactgcgaatcaagcagctactacaccagctgccgccacatgacaatgaggttcgatattgcaactccctggatgaggaagagaagagggagctgaagcttttcagcagccagaggaaacgcgaaaacttgggccgcgggaatgtcaggcctttcccagtcaccatgacaggagctatttgtgaacagtgcggaggccagatcaatggtggagacatcgctgtgtttgcgtcacgcgctggcca

SEQ ID NO: 23600 - DNA, 1393 bp, Homo sapiens
cctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatatctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactata

SEQ ID NO: 23601 - DNA, 1475 bp, Homo sapiens
ccgccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaagggcaaagactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttatgggtctgttccttaatgacccatcaccaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatatctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactatatatgtgtcttaaacctcaaagtaaattttccttg

SEQ ID NO: 23602 - DNA, 2657 bp, Homo sapiens
gaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacc

SEQ ID NO: 23603 - DNA, 806 bp, Homo sapiens
agtcgctgacagccgcggcgccgcgagcttctcctctcctcacgaccgaggcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttc

SEQ ID NO: 23604 - DNA, 2539 bp, Homo sapiens
cgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacc

SEQ ID NO: 23605 - DNA, 1431 bp, Homo sapiens
agtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatg

SEQ ID NO: 23606 - DNA, 855 bp, Homo sapiens
gggggcaggggagccgcgggggccgagtgaggaccccgggcctcgggtcccaggcgcaagggtgcccggccgggcggggtcgggaccccagtgaggaggggccgggggctgccccgcgggcgcgtgacgcgtctcgggcctgcccggctgcgctggtctccgctcgggtgaggcggcttggcttcgcttttcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccag

SEQ ID NO: 23607 - DNA, 3980 bp, Homo sapiens
gggtgtgctgggggactgtgcagctcgaggctccagaggcacactccagagagagccaaggttctgacgcgatgaggaagcacctgagctggtggtggctggccactgtctgcatgctgctcttcagccacctctctgcggtccagacgaggggcatcaagcacagaatcaagtggaaccggaaggccctgcccagcactgcccagatcactgaggcccaggtggctgagaaccgcccgggagccttcatcaagcaaggccgcaagctcgacattgacttcggagccgagggcaacaggtactacgaggccaactactggcagttccccgatggcatccactacaacggctgctctgaggctaatgtgaccaaggaggcatttgtcaccggctgcatcaatgccacccaggcggcgaaccagggggagttccagaagccagacaacaagctccaccagcaggtgctctggcggctggtccaggagctctgctccctcaagcattgcgagttttggttggagaggggcgcaggacttcgggtcaccatgcaccagccagtgctcctctgccttctggctttgatctggctcacggtgaaataagcttgccaggaggctggcagtacagagtgcagcagcgagcaaatcctggcaagtgacccagctcttctcccccaaacccacgcgtgttctgaaggtgcccaggagcggcgatgcactcgcactgcaaatgccgctctcacgtatgcgccctggtatgtgcctgcgttctgatagatgggggactgtggcttctccgtcactccattctcagcccctagcagagcgtctggcacactagattagtagtaaatgcttgatgagaagaacacatcaggcactgcgccacctgcttcacagtacttcccaacaactcttagaggtaggtgtattcccgttttacagataaggaaactgaggcccagagagctgaagtactgcacccagcatcaccagctagaaagtggcagagccaggattcaaccctggcttgtctaaccccaggttttctgctctgtccaattccagagctgtctggtgatcactttatgtctcacagggacccacatccaaacatgtatctctaatgaaattgtgaaagctccatgtttagaaataaatgaaaacacctgagctggtggctgtgtactttgactggtacatggaggctattttaatccttctaactaaactaaaatagattaaaggaattaaactaaaatacaagtaaagctagacaaaggcccagaaatcatactgtaaggaaatgttattggaagctgattcccagagcagaccacatatacagcaggatgtgcctgtggcatgaagattttctttctcttttttttttttttttagatggagttttactcttgttgcccaggctggagtgcaacggcatgattttggctcactgcagcctctgcctcccaggctcaagcacttttcctgtctcagccttccgagtagctgggattacaggtgtgtgccatcatgcctgactaattttgtatttttagtagagacagggtttcaccatgttggccaggctggtcttgaactcctgacctcaggtgatccacccacctgggcctcccatagtgctgggattcaattttttttttttttttttcaaaagaagggtaagtgcttgctgttcccatccctgaaacattgcatgtatttaagaaaaacaaaatgttagtggcatatttgcttctaatgttcccctaaccctacatgcatgttttatgtgcactcatatgagtatctttaaatataatccctttacatctgtgttctatgcaaagtctctcatttctttcaagacagcctaatgaaggccatcatctctgtaaaccacttgtcactacaaaaatacaattactcaccaaaaagctttaaaaaataaagctgtgtctttagggagacccaataaagaatgcaatccatgccataagcaggagttgatacaccaccttattagctaaaaatatatataacacaatatgagtaatgtttaagatctgttttaaatttaaaacaatgaattgaatgctctaagaggctcctacaggcgctccaggccactctcagagactcccaggagttgttgaactatatttggagaaaacagccactgaatattatcatttctcctttaaagagagtttgtaaggggggaacatgcattttatcagacaatttatccaaagcattgcagaacatgagtgctgatgagggcacctcttgtgctgagtcccctcagctatcagtgttcttctcaaggacacatttggaaggttttaacattgaaagtgagcggaggacttgggggcagagcagcacaaagaaacagccttacactgggcacatggaggagacgtccaccctgcagccaggactggggttcacgtcactgccagagctacactcgccttctgcttccacggtcctgttaattctagatcagagagcaagaaaaaagtacagaacatatcctctacggttatttcctgctttctaattaaaaaaataataaccatggcaagagagaaagaaagagaaagtactcagaggctgacactgacatttcacttcctcgctctcctaagtttaattacaacagcacgtgcagccacgtcagccaaatgacttcatttctgatgtgaaaacgcttaggccatgatgtcgttcattttctgtaattgctgccttttctcattctgttaatagtcccggcaaccagatttcagtggggcatgacgtgaatgtgtatatggtgattcaaatgcaaaatttgtttatggggcttttaatcgaacgcgtgtgtgcctgaacattcttgctcaagttgatgaatcatggggtggaataaaggctgagtttagtttttcactttagcaaaggggcaatggggtgcctactatgtgcgagacattgggaggggcttctgaattattctggatatcgtcattttgcagtgtgcataattttgccaaccgttgctttcgtagcccctgctaagtgttgactttttaaaatataagtttattgtaaaagtgacatgaaaattacaacagatattccagaccaaaataatacaacaatcccagcatctgattgagtcagtgtttgctgtttcccctgcactttcctagttcttaagcatttgcgtatgtaaacattcatatttgcaataaaaaagtgagcttttatattctaaatttttacttaacttaattcaatgctttctactcatttttctatacttttttttttgaggcagagtctcattctgttgcccaggctggagtgcagtggcgtgatcttggctcactacaacctccaccttccaggcttaagcgattctcatgcctcatcctcccaagtaggtgggattacaggtgcccaccaccaagccctgcaaatttttttgtatttttagtagagacagtgttttgccatgttggccaggctggtctcgaactcctgacatcaggtgatccacctgcctcggcctcccaaagtgctgggattacaggtgtgagccaccacgccctgcctactctttgttttctttcctccccacccattttcccccgtcctgtcccctccttccagcctgagatgtaggctccaccttaactgtgctcagatacacaagtgagggctttttaacttgattatgccttttaaaaatactatgtatgtaaaatatttattcatctgcaatttggcttccctaacttaacattgcatcatgaaactctttggaacaacagctatctagatagctgactcattcttttggattgctacgtaatctcacttaatacagatgtatcatgattgattgaatcattgccttgttgatgggccttcagattatttccagttttttgccactgcaaacaataaacatccttgtacatacta

SEQ ID NO: 23608 - DNA, 9129 bp, Homo sapiens
ttttccgctcgtgcttcggcgccgctcggctcccttcccgcccctggctccctccctccctccctccctccttcttctccctccctcctgtcctgggattgcctggagctccgcaccgcgagtttgccgcggcactttccgcgcggcggaagagcgcgcgccagcttcggcacacctgggagccggatcccagccctacgcctcgtcccctacaagctcctccaagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactattcagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaattattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggcttttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccacttaatttcttgaaaatagtacaagtcagtgtaatagagaagcattcatatattcaacactgtaagacaaaacagcagagaccttggatttgataattgatctgatatcctggacagtattcatatgtacagtgataggtatctttctttggagttttttttttgtgcatatgtgtatagttttatgggttctgagttggtgaccagtaagttgcatgtagtgctggcacttacttaataactattcatgatattgttaataacttgttataggattgtattcccaattacagtctctaagattgtaattgatattatctgagaggtagtgtgacaactttcttttgttgttacattaagccgaaaacataatactaatagacaactaacagtttgcttatcaggcacatcaactaaggcacctccccccatgctaagtttctcctggatatatggaagttgattgtttcccagtttaaaaacttgaactaatatctcctaagaaaatctgagtccatattgtttttattttacttagctagaatctcatagcatgttaaagtcatatccttatccccactaaaaataactatgtctatgtgagaggaatatagtatgtgggagctgtattaaatactattacaggtgttacagaatctttaaataaatggacatggaccaactttccatctagtagtgtacgatctatatagtgcatgtcagtagcacaaaatgcagtcttagcattagcctgtctaatctgaatagtttactcaaaagtacttctttgtgttaagtattcagccactgtttttagatctagttaataggttctatttaatttgctacaacatttactgaatggtggagtgaaaaaactgatgcatactgggaaatatctaccattttttaaagataatgttaattaggaaaagaacacttttaaggaatttatagcagtgatgaaatgaattcagttatatcagatacaccaaactgttgatggtatttaaatgtgacttcaagttagtatttctgtatatattattgattactggtttgtttttagatatgtaagtctgttctaatctacagttcacatatcgacagttactctggtaataatagaatgttagtgatgatcacttggtggatgttgattaagtgcctgtgttttgtttcctcctctggataccaaataggtgtatgctacttttttggtgaacttatttcttggaagatttggctatgctattcagggtttttattcttatgtttttcttctaaatttaagtagcatcctgctgctaccatattaaagctaaaatttaacttttgctgaagaatcagctaattcaggtaatccaaatatttgtggaaaaacatctggataatttattgaacacattagtattgtgttagacagctttgatcattcccatttcataggtttttattgtggaatagtcaacttaatatagattcactttcaatttgcatgtataaagtaatactcaataaaatttttttcatttatttttcaacagtggttattttttttcttcctgtactatcagtaaaatcctgactatgagttttacttttgaagctaaaggataatgctggtaatctaattatgtacctcttacagaaaccatatgcagcactttaaaaatctttatttggtatattattttaggtggacaatgatttaagactcaaagccatcatattaaggtctaaatacattagtggtggggtttctcgaataaatgaggaagtgcacaaaagttcagcctgactgaaaattttaattgtgttttaaaactacatgaataatttcttgattcaaaatcagaactcttataaactaaatctgatggtgtccaaagaatttcaggtccttcaaagtttgtaaaagataagtaggggcctaggaatataaaaatttagacttttttagtaaatggtttacataaccttttgtcttaatttgtcattcttcatacacaggcacaagctaatcagtcttctctacttctagaactctaaatcttctcagtaatgtcatacaagtctaacaagaggaaaagcatccttaagtcagtctatttagataaactcttcaagtccctatataaggacgtattccactagcaagccagtaaatttttccaaggtcacataatcttacatgaaatggaacctttcatcttagacttcatcaaactcaattttttcccttctagattcactttgtgtttatgcatgcatgcacgcgtgcacacaattctatcagcagctgtaaactacccacatattttcttaatctcattttttcagtttttcttcatctttaaaagaggttacatttcattcctggtcaactcttaaaaagaattatgtaatgttgggccttcatattaaagagagagactggttataagatcctttacagtccattcattttattctgatgtctaaccagatagacactagcaagcaaaacttccctcttaatcctggaccaaatgcataattttactgtcactttcaaaaatctgttatgactgaatcaaaatccttttaaagaaaggaaaaagctccttttgtgtcaaatagttgaacaacatgaaaacagtatgagccggttaaagatagattgaatttttactttacacatatgaaaaacagtaagttttgactgctgtgtatgttattcatgttaatatgtgctcagttattcactattgttaatccacatataatcagttgctatccctggttagacacactatggaacttgaaatgcacaatatttacattgttagaggcttctatccaaatatctgcattcctttaaaatgtgaactatttgctgtgattaaccaaaggtagattatgtcatcagtggacattttagctttatggaaacaaattattaagaaatgaatagaaaggtgtctttttctttgtgtagtgcaaaagcctaaagctatcagtcaaaggcctaagaaatccacatttgaaaaacgtaaatcatgattggtaagaatacattcatctgatagtattgagaaaagttgaaaaactgttagccttccataacacattaaacattttatgtatggatggctgaaagtattgagaaaagctgaaaaactgttagccttccataacacattaaacgttttgtgtatggatggcttaggacaataaacaacatcattaaagtaaaattatgtcagtctgttcatattaacttatttaaatcaatgaaaattttgatgagatgactaaatggatgctttggaaatgcaggattataggaggcctaaaagtgcatcttgtttcttgtaacccttttaaaaccaatatgcctggctaggtgcagtggctcatgcctgtaataccaacggggtaacacagggttatgccgtctatacaaaaaaataaatgagctgggcaagatggcatgcacctgtagtcccagctgcttggtaggctgagggggaaggattgcttgagcctgggaggtcgagactgcagtgagccaagatcacaccactgcactccagcctgggtgacagagcaagactctacctcaaaaataaaaataatcaatatagtttcaatgaagcaaagcatctcaggtaacaatttgagcataactttaaccataacttatgatagcataataacattcattagtaattcagtagccgtatgtgccaggctgtgttaggtgctttatatattgtttaatttttaaaaacttgtggagtgtacagattggtaaggtgacattgtatcacaaagctagtctttgagtccaaagttttgtggttttatgttatgatatacttttatcatggaattgtcttattaaatgttttgccagtggttcttaaagtgtgtttctgacaccagtagcattgacttcacttagaaacctgttagaaatacaaattatttggccccacccaacacttgagtcacaaactttgcagatggggctcaatctgttttaacaagcgcttcatgtaattttgatgcaggcctaagtttttgagccactgcagtatgcatttctatttttaagcaaagatcttggtctttctttttggacattgtagaaataacatgaacttgttttttgtttgtttttgttttgttttgttttaagctcctgatctttgttggttatgttgcaaaagattgtatcaggagaagcctcagcatggacattggcatcctgacataacccccattaatttagtattctttctgaaactcaaatggattctcaagtccaagagactatggaataaaatcattgtttgtctgtgttaagttttatctctgttattgcctgaagacttttggtaacaataatgcgctttcatcaaacttttaagacttgattggaaaaaataaatgtatgtttcatcagttatacaa

SEQ ID NO: 23609 - DNA, 494 bp, Homo sapiens
gcctcctctgcgaaccggctaggagctccgcgcctcgccttgggagtggggttgtagctgacggggacctcggaccggcggtggctagagcgcggagcaggcgatacgacgagccgacagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcgg

SEQ ID NO: 23610 - DNA, 364 bp, Homo sapiens
ggcgatcgtcggggtccgtactgtagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgc

SEQ ID NO: 23611 - DNA, 3385 bp, Homo sapiens
gtttgctttttaaaaaatattttaggctgggcgcagtggctcacccctgtaatctcagcactttgggaggccgaggcgggtggatcatgagatcaggagttcgagaccaacctgaccaacatggtaaaaccctgtctctactaaaaatacaaaaattagctgggcgtggtggtgtgtgcctgtaatctcagctactcaggaggctgaggcaggagaatcacttcaacctaggaggcagaggttgcagtgagccgagatcacaccattgcactccagcctggacaacacagcaagactccgtctcaaaaaaaaaaatattttaatgatgaaggaactatgttgtaattgcaactcaaggacgacccaccccaccaccatcagggaattcgaggggagactggcagttatccagggatcccagaaggagtcaactgggagttaagagtcctaacaaccctagaaaaaaactttcaaagacacaggtcttctcattaatctccataatcacagaggtcttgcctaaaagggccccccttgagtacacagctctgaaactggctaacatcttctgctgtctcatttgattttaaagttcacatttgtgaagggctctattgtacaacatggtgactatagttaataacagtgaatttcagttaataacctgaatttcactgagagtaggtctgaagtgttctcatcacaaaatgagtgtattagcatcgctcatagctcatttagccattacacaatgtatacacatttcaaaccatattgtataccataaatacatacaattcttattggttaattttaaaaataataaaagttctctatcagtcccataaattacaattttcaggcatctgcaaaggcagcatgttttggtttaaatgtggtctttccaaattttatacgtataaaataaatgcataagtgtactacatatgcaaaaactaatacataaattttataaagtcaatgcacgcggggtcactgggatgaaccaatttcagtgcctgcagtctaatgtttaaaatcaaaatggtacaaggtcaccaccaaagaaattgtttaagccaatgtttctcaaactaaaacctttggacatactcccagaatcccctgtaaagaaatgtatactgtactcaaagttgagaaccactgacttagcataaagggaccgtatttcttttctctcccacccagcacaggcccagtgctcagcagaaattggggctccacagttctgcccaacactgggtcactgctgagaagtctgcaccaggccttcctgcacctttccactgagcaatggagtttgtttattcatttatttatttatatggaatttatttatttattttggagacagggtctcactctgtcacccaggctggagtgcagtagcgcaatccaggttcactgcagccctaaactccttgggctcaactgatcctcccacctcagatacccgagtagttgggactacaagcacgcaccaccacgcctggataattttttttaaatgttttgtagagatggggtctcccgatgttgcccaggctggtctcgaactcctgggctcaagagatcctcccgcctgcgcctcccacggtgtgagccacctttgatcttattgctatgatttttttattgataaaaactaataaatattctgagtctcaagaaagctttctgaaactatcaaagggacccaggcggcgcatcactacctgtgaggccgaccccactcacagcacagactgcaagtgaggcttacagatgggaagtgccctaagcgaggttaaacagctagttagcagcagacacggaactagaacctaagcctgctgtcccagcttcggtgcccgtgctcacagcggaagctgcctcggctcatccgtaagggcgctgattagggacgacaaagacctcaccccaccgtccccgtcccatttccgccctcccagatccccaacctccttcgagtcctctccaagtcgcctcgcctcgctccactccaggccttagcaagcattccacatgcctttaccccaaccctactgcctgtcccccaaaagatgcaggcggaaaagaccccaggaagcgagcccactcctccccactgctcagcaacaccgcctacgacgttctcagtagccgaatccctttccaggcgcatgcgcccccgaggtgggcgagcgccggtgatgtcacgcatagcgccatctccgagctccgagagtctgcgacagcagctgccagtgcgtcatcagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacagtacatatgtggacataaacagggatcaaataaaggaggtattgctgca

SEQ ID NO: 23612 - DNA, 2594 bp, Homo sapiens
agtctgcgacagcagctgccagtgcgtcatcagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacagtacatatgtggacataaacagggatcaaataaaggaggtattgctgcagtccagccaggttgaaagggaaggggggtccccaaaggtccattggatggcaggtgtctacagaggctcgcctttgggtggaactctgacccacctaaggtttactttgctatttcaggaaggttgaagaggattgaagggtgagttgctaagtgacttagggtttattcacttcaggaatcatagctggggtggaccccaggagcagagtactgcatgcagctgtgcccatgcatggttgccccagcgtagtgagatgggacctgccgcagcatgcccactcctgagctgccaggctgagccatggaggactgaaaggaggtcgcccggcatcacctcccgaggtgagacctgctgcaaaagccaagccagcagcattgacgccctttgatatcttcgccatttttgctgctgaaagacttggcttttcagtctgaccctggccctctgtgaccatgtgtctgtaaagccagtgggtcaggcccttccatgcagggccagaggaaaagcgggcccagggctgcagtgagagcggggcaggggaccagcctaccagatgggttggaaacatggctcagaaggaccaactaccccttccctttgaggagcaagtctctgccgatcagcaaggcaaggccaggagccctcctggcgaaaggcaggccacaaatctgttctcccccaggagaagtagcagtgccagggctttgcgtttctggtaacttccacccaaaccacaccagagagaaacaccgtagtggagaagggaagtgggagcgctgactgctgtgtgccaggagagtagaaaggcccaggtctgtgccaccacccctccccaaagctcagtgcacccagagtctcacagggaccaacacggtgcctcggtcctgcttccatccatgcaagtgtcctccgctcaccagggtgttctgaggcagctcaagtgctctcccccaagcagcacgcagtcaccgctgccagtgatgaacacacgcacgggctaggcacatggagcccaagcacactgccacctcggacacgggccccggcccagcgactgccttgtggtgtggccgtcctcatctgccacaggaagacagacttcgagggacctcttgcctaaggcctcgctgactcaagggtagattgagatttggacctaataggctccagaactgtgctttgagctacagggtggctgcaggatgagacggatgcagttcaaagtgcaggatgtgctgcctttattacctgctttcccgctgagcaaatccctgtcttgagtgggaagtggcatctattcccccagccatctgaaaatgctgtgttcataaccaaataggtgctgtagcttcctagccatcccgctcttacccgcccctctgcaatgtaaaaggcgtccactgttgtgtaaatacacagttgctttccagaaaagttgtaggtaccacttgc

SEQ ID NO: 23613 - DNA, 854 bp, Homo sapiens
agcgccggaagcggtccgagaatgaagagtgtgatctaccatgcattgtctcagaaagaggcgaatgactccgatgtccagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacagtacatatgtggacataaacagg

SEQ ID NO: 23614 - DNA, 913 bp, Homo sapiens
agagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcgggtacaataagaacatgtcagaagttcctaattcagtacaacaggagacagctgttgatcttgttgcagaactgcactgatgaaggagagcgggaagctatccagaagtctgtgacaagaagctgcttattagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggcatttagcatacttatattacagaaagggcttatggagtccatgcttggccaagtctctgttctctctctatccctagccttggtgggaagactgactccctatgtggtactagttaaacttttttttttgagacagtctcagtctatcacccaggctggagtgtagtggcccagtatcggctcactgcaacctccgcctcctgggttcaagcaattctcccacctcagccttccaagtaactgggattacagacgtgcaccaccacgtctggctaatttttg

SEQ ID NO: 23615 - DNA, 801 bp, Homo sapiens
ggtttgcacgccggaccggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcggttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttattagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 23616 - DNA, 927 bp, Homo sapiens
ggaaggggcggggcgaacggaagccgggaaggcgattcatagctcgcggggtacgggcgcgcgtgcgcactccgcagcccgttcaggaccccggcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagaggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggatccgcaacaactcagccatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagtgtcctgcca

SEQ ID NO: 23617 - DNA, 483 bp, Homo sapiens
agtttgagggcgacgcgatgaatgaatcggaacggggggtggggagacgcgggatctggagggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggatccgcaacaactcagccatccacatccgagtcttcagggtca

SEQ ID NO: 23618 - DNA, 1702 bp, Homo sapiens
gatgacgttacttgaggcctgggagacggcctctgcccctcactgctcctccccctcctaaggtcaacatttatgtgtcctagacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaa

SEQ ID NO: 23619 - DNA, 2021 bp, Homo sapiens
gaacaaacgggatattcagcagtggcctgtggctgccagagcagctcctcaggggaaactaagcgtcgagtcagacggcaccataatcgcctttaaaagtgcctccgccctgccggccgcgtatcccccggctacctgggccgccccgcggcggtgcgcgcgtgagagggagcgcgcgggcagccgagcgccggtgtgagccagcgctgctgccagtgtgagcggcggtgtgagcgcggtgggtgcggaggggcgtgtgtgccggcgcgcgcgccgtggggtgcaaaccccgagcgtctacgctgccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattaca

SEQ ID NO: 23620 - DNA, 2940 bp, Homo sapiens
cggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaacca

SEQ ID NO: 23621 - DNA, 819 bp, Homo sapiens
cctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggtgagccggctgcattcttagattccttccagttcagagtccctggttttctgtgagtagagccactagactgtagaccccaggagcttggctgctggccttctctgggcacctagctgccctgatgtgacgtggcagagtcggtgtggggaatgagggctgaacttggggacagattccccacactgggtgag

SEQ ID NO: 23622 - DNA, 2655 bp, Homo sapiens
ctgcgagcgccgccgggtcggccgatcgtcccccatacctcggccatgcggcccctgctgctactggccctgctgggctggctgctgctggccgaagcgaagggcgacgccaagccggaggccccctgttgccaagagggcctcagagctggtggctctggttctcttcacctggggagagacttcaccgtcctggcaggagctcgggggagcccttccccaagtgtgagcagcatccctcgtttctggatcccaggttcagacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctg

SEQ ID NO: 23623 - DNA, 1500 bp, Homo sapiens
agtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgctggaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctc

SEQ ID NO: 23624 - DNA, 887 bp, Homo sapiens
gccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggtgtctccctggggccagggccaccttcctggggcctgctatgaactcactgcctctgtcctcacatctgagctcagcgtgatgccttcttttcctgctgtggtgctgcagttgaactacctgggcaactacatcccgcgcttctggaccttcgaaacaggctgcaccgtgtgtgacgaaggcttgcgcagcctcaagggcattgggg

SEQ ID NO: 23625 - DNA, 762 bp, Homo sapiens
gtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggccccctgttgccaagagggcctcagagctggtggctctggttctcttcacctggggagagacttcaccgtcctggcaggagctcgggggagcccttccccaagtgtgagcagcatccctcgtttctggatcccaggttcagacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcg

SEQ ID NO: 23626 - DNA, 3732 bp, Homo sapiens
ccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 23627 - DNA, 3665 bp, Homo sapiens
ccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataatttta

SEQ ID NO: 23628 - DNA, 3043 bp, Homo sapiens
aagtgctgactgggaccgacagtgagggaggggagcccagagggaagttgataacccaaatgtcatctggtatctccagttgttcattccttgatattgctgatgataatgttacaaactgtaccagggaaagcaaacatagtcactgcccctggtaagaaggcaggggaataactatcttagaaaatttgatgaaaatcaagtttgtaaaatattaatacctgaaaagtcatatacttacatctccaacattcatttaaaactgagttgtgggatatgtaagttgcatttgtgtgcatgtgtatgtatgtatgtatgtatgcagaaacattttgatttgtggatgttttatgccttaaaatatttactggcttgaaaatatattttaactggcttaaaattttagaggtgagctccctgtgaatatccgtgttaaattgaccattttgaaatttaagacaatatatatatcgtttcagatattgttccactattttgatcagaaaagtatgctagagaaccatattttacataaaagaatatatatattaacatttttcagtcagcagatatttattttatgtcatgcccatttcattttctttttcactgttagggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 23629 - DNA, 2908 bp, Homo sapiens
aatatggggggatgcacggtgaagcctcagctgctgctcctggcgctcgtcctccacccctggaatccctgtctgggtgcggactcggagaagccctcgagcatccccacaggtgagcaccccgcggtccgccgctgtcccgcgaggctcggccggcgggggggcagttcattcatccaccagcccttccgcggggctggccagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaaga

SEQ ID NO: 23630 - DNA, 2920 bp, Homo sapiens
actctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 23631 - DNA, 563 bp, Homo sapiens
atgcttgcagttccagccactccggaggctgaggtgggaggatggtttgatcccaggaaatcgaggctgcagtgagctatgactatgccactgcactccagcctaggcgaaagagcgagaccaaaaaagaggaatgactagatgctgtgatcacaaaggcagcccctggagcttctccgggcagaagaggagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcg

SEQ ID NO: 23632 - DNA, 1415 bp, Homo sapiens
agcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccggggggtccagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagct

SEQ ID NO: 23633 - DNA, 2555 bp, Homo sapiens
atttgaaggggctttggtggtgttcacagctgcctctttggcacctcctcccaagccggagtcaaggaggcccctgagccttggaccagccactgccacctccgacctgctcggccagaagctgcccagggacaaagcagagtgcaggtcatttatcttcaggctttgagatctgcgtggggggagctgttgcagcagcccaagccgcaggaattgctgagacaggatggcctggcaggggctggtcctggctgcctgcctcctcatgttcccctccaccacagcggactgcctgtcgcggtgctccttgtgtgctgtaaagacccaggatggtcccaaacctatcaatcccctgatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataagcacctcttttcatggagtagagtcaggagaaacccctgacaccttttcaggttggagtgcattcattcatcctcttatatgtgccccttccccatgctcagctcagcattgtgtacaaaatatccaagcccagcctatctctcttctgcgtgggagtatgttatttctctggggtctgtgatggggaagggtggatgtcccttccccacaataggcttagtgcttggctcagacacctagactctaaaactatcagcagcggcagcagcagcagcagcagcagtttgtgatctgtccttccaacctgttcacgtgactcctcaattccagggaaccagagcgatgtgttctttgtacctgtaggtctatgatgtccaaacttaacagatcacatgcccctcttagaagaaatatgagcatgctccctcatgcagatagtatacacatcataaacaaagagtagaactttaaaagaaggtaaataatcatacacagaaatcctaacattatattcccaaatctcaaaagatctcctgtgcacctgactttggagacgatgctttaggtaaaaagcttaaacattgccttatattggatcaggaacccttacagtagagggtccagtcttctagtgggtttaatgtttagtcagtgtactctgagtcctcattgttcagaaaagcacctcttgaagaactgacttcctgaactcccagtcatgttggtaccctggacagtgcctaactccttacagaagggagtgaaaacctctttcggaaatgattgagagcagcctcttgaatgcttaaatgatcaaggagggagaaaggcaaaccaatttgttctgtgcaacaaactcaaaatgtggaccagttccctcagccctcattaaactaattaaactgatgggtatcatgcttctactccatggtgaactgaagcagagtcaagctgatgaagttaagcacaaccatgttcttgagcagctgaattggctgccaagagtccaagccatctggcccaacatacgcactgggcattgggtaagggactccagaagcagcagctagaaagagaaaaagccctcttcaatccccataatgcttctttcctcttaatgtctcaaaataaaaccagaaagaggaataaaatgattaagtgcttgaggccaaatgagttcccttgattcaaataaccctgaatcagaggcagagacctcctgatgtcttggtttccatcaaagccctccctgtctgtctgtctctcttttgctctctcattcccaggcactctcttttggtttgtgggtccaggagatgaggctggataggagaggaaaaggcttgagtctggataatttgtataagatgctgctgagcacatctcttcatgcgcagtccccaggtatctgatgatgttctgaaatggatagattgttttagagttattttgtgtcctttaaaaaaatcccatttatgcaatttacttggaatttgcttagcctttaataggcttgtgtaatttcctgctcctccagtacaataaataaaagaaagatgctga

SEQ ID NO: 23634 - DNA, 2526 bp, Homo sapiens
aaaaggggggaagaggcaccagaactgccatttgaaggggctttggtggtgttcacagctgcctctttggcacctcctcccaagccggagtcaaggaggcccctgagccttggaccagccactgccacctccgacctgctcggccagaagctgcccagggacaaagcagagtgcagcaggaattgctgagacaggatggcctggcaggggctggtcctggctgcctgcctcctcatgttcccctccaccacagcggactgcctgtcgcggtgctccttgtgtgctgtaaagacccaggatggtcccaaacctatcaatcccctgatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataagcacctcttttcatggagtagagtcaggagaaacccctgacaccttttcaggttggagtgcattcattcatcctcttatatgtgccccttccccatgctcagctcagcattgtgtacaaaatatccaagcccagcctatctctcttctgcgtgggagtatgttatttctctggggtctgtgatggggaagggtggatgtcccttccccacaataggcttagtgcttggctcagacacctagactctaaaactatcagcagcggcagcagcagcagcagcagcagtttgtgatctgtccttccaacctgttcacgtgactcctcaattccagggaaccagagcgatgtgttctttgtacctgtaggtctatgatgtccaaacttaacagatcacatgcccctcttagaagaaatatgagcatgctccctcatgcagatagtatacacatcataaacaaagagtagaactttaaaagaaggtaaataatcatacacagaaatcctaacattatattcccaaatctcaaaagatctcctgtgcacctgactttggagacgatgctttaggtaaaaagcttaaacattgccttatattggatcaggaacccttacagtagagggtccagtcttctagtgggtttaatgtttagtcagtgtactctgagtcctcattgttcagaaaagcacctcttgaagaactgacttcctgaactcccagtcatgttggtaccctggacagtgcctaactccttacagaagggagtgaaaacctctttcggaaatgattgagagcagcctcttgaatgcttaaatgatcaaggagggagaaaggcaaaccaatttgttctgtgcaacaaactcaaaatgtggaccagttccctcagccctcattaaactaattaaactgatgggtatcatgcttctactccatggtgaactgaagcagagtcaagctgatgaagttaagcacaaccatgttcttgagcagctgaattggctgccaagagtccaagccatctggcccaacatacgcactgggcattgggtaagggactccagaagcagcagctagaaagagaaaaagccctcttcaatccccataatgcttctttcctcttaatgtctcaaaataaaaccagaaagaggaataaaatgattaagtgcttgaggccaaatgagttcccttgattcaaataaccctgaatcagaggcagagacctcctgatgtcttggtttccatcaaagccctccctgtctgtctgtctctcttttgctctctcattcccaggcactctcttttggtttgtgggtccaggagatgaggctggataggagaggaaaaggcttgagtctggataatttgtataagatgctgctgagcacatctcttcatgcgcagtccccaggtatctgatgatgttctgaaatggatagattgttttagagttattttgtgtcctttaaaaaaatcccatttatgcaatttacttggaatttgcttagcctttaataggcttgtgtaatttcctgctcctccagtacaataaataaaagaaagatgctgatg

SEQ ID NO: 23635 - DNA, 2472 bp, Homo sapiens
agaccagtgagagactgctctttggactctccctttctgcacagtcctggcttaaacaggtggtcatttatcttcaggctttgagatctgcgtggggggagctgttgcagcagcccaagccgcaggaattgctgagacaggatggcctggcaggggctggtcctggctgcctgcctcctcatgttcccctccaccacagcggactgcctgtcgcggtgctccttgtgtgctgtaaagacccaggatggtcccaaacctatcaatcccctgatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataagcacctcttttcatggagtagagtcaggagaaacccctgacaccttttcaggttggagtgcattcattcatcctcttatatgtgccccttccccatgctcagctcagcattgtgtacaaaatatccaagcccagcctatctctcttctgcgtgggagtatgttatttctctggggtctgtgatggggaagggtggatgtcccttccccacaataggcttagtgcttggctcagacacctagactctaaaactatcagcagcggcagcagcagcagcagcagcagtttgtgatctgtccttccaacctgttcacgtgactcctcaattccagggaaccagagcgatgtgttctttgtacctgtaggtctatgatgtccaaacttaacagatcacatgcccctcttagaagaaatatgagcatgctccctcatgcagatagtatacacatcataaacaaagagtagaactttaaaagaaggtaaataatcatacacagaaatcctaacattatattcccaaatctcaaaagatctcctgtgcacctgactttggagacgatgctttaggtaaaaagcttaaacattgccttatattggatcaggaacccttacagtagagggtccagtcttctagtgggtttaatgtttagtcagtgtactctgagtcctcattgttcagaaaagcacctcttgaagaactgacttcctgaactcccagtcatgttggtaccctggacagtgcctaactccttacagaagggagtgaaaacctctttcggaaatgattgagagcagcctcttgaatgcttaaatgatcaaggagggagaaaggcaaaccaatttgttctgtgcaacaaactcaaaatgtggaccagttccctcagccctcattaaactaattaaactgatgggtatcatgcttctactccatggtgaactgaagcagagtcaagctgatgaagttaagcacaaccatgttcttgagcagctgaattggctgccaagagtccaagccatctggcccaacatacgcactgggcattgggtaagggactccagaagcagcagctagaaagagaaaaagccctcttcaatccccataatgcttctttcctcttaatgtctcaaaataaaaccagaaagaggaataaaatgattaagtgcttgaggccaaatgagttcccttgattcaaataaccctgaatcagaggcagagacctcctgatgtcttggtttccatcaaagccctccctgtctgtctgtctctcttttgctctctcattcccaggcactctcttttggtttgtgggtccaggagatgaggctggataggagaggaaaaggcttgagtctggataatttgtataagatgctgctgagcacatctcttcatgcgcagtccccaggtatctgatgatgttctgaaatggatagattgttttagagttattttgtgtcctttaaaaaaatcccatttatgcaatttacttggaatttgcttagcctttaataggcttgtgtaatttcctgctcctccagtacaataaataaaagaaagatgctgatg

SEQ ID NO: 23636 - DNA, 1199 bp, Homo sapiens
cggcgagggtcctgccgagggaccccgttctgcgcccaggcaggctcgaagcacgcgtccctctctcctcgcagtccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaatatcttttcccactagtggccccaggccccagcaagcctccctccatcctccagtgggaaactgttgatggtgttttattgtcatgtgttgcttgccttgtatagttgacttcattgtctggataactatacaacctgaaaactgtcatttcaggttctgtgctctttttggagtctttaagctcagtattagtctattgcagctatctcgttttcatgctaaaatagtttttgttatcttgtctcttatttttgacaaacatcaataaatgcttacttgtatatagagataataaacctattaccccaagtgcataa

SEQ ID NO: 23637 - DNA, 1029 bp, Homo sapiens
ctgcgtcagctgcagcccgccggcgattggggcgcgcgcgcctccttcggtttggggctaattataaagtggctccagcagccgttaagccccgggacggcgaggcaggcgctcagagccccgcagcctggcccgtgaccccgcagagacgctgaggaccgcgacgagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaa

SEQ ID NO: 23638 - DNA, 467 bp, Homo sapiens
gacggtgaggccctacgtccgccagcacacccgggcccgcttctccccgacgcccgccctcctcacacttgccttcttctcttccctctagagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaag

SEQ ID NO: 23639 - DNA, 781 bp, Homo sapiens
gcagcccgccggcgattggggcgcgcgcgcctccttcggtttggggctaattataaagtggctccagcagccgttaagccccgggacggcgaggcaggcgctcagagccccgcagcctggcccgtgaccccgcagagacgctgaggaccgcgacgagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaaaaaaaaaaaaaaaaaagaaaagaa

SEQ ID NO: 23640 - DNA, 2261 bp, Homo sapiens
gccgctggtttgtcagccccgcggctgcgggcggccgggcggccgagcgcgctctgaggttcgtccctcatcgctgaacccgcgtcctcccgccgcagctcctcggggaggggggcggtcggtgcctgcgcagagccgcctcctccccgcccccgccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaa

SEQ ID NO: 23641 - DNA, 1780 bp, Homo sapiens
gcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaa

SEQ ID NO: 23642 - DNA, 530 bp, Homo sapiens
cgcgtggcgcctctatatttccccgagaggtgcgaggcggctgggcgcactcggagcgcgatgggcgactggaaggtctacatcagtgcagtgctgcgggaccagcgcatcgacgacgtggccatcgtgggccatgcggacaacagctgcgtgtgggcttcgcggcccgggggcctgctggcggccatctcgccgcaggaggtgggcgtgctcacggggccggacaggcacaccttcctgcaggcgggcctgagcgtggggggccgccgctgctgcgtcatccgcgaccacctgctggccgagggtgacggcgtgctggacgcacgcaccaaggggctggacgcgcgcgccgtgtgcgtgggccgtgcgccgcgcgcgctcctggtgctaatgggccgacgcggcgtacatgggggcatcctcaacaagacggtgcacgaactcatacgcgggctgcgcatgcagggcgcctagccggccagccaggccgcccactggtagcgcgggccaaataaactgtgacctgggcg

SEQ ID NO: 23643 - DNA, 1371 bp, Homo sapiens
actccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctccaacttgtgggtgccctctgtctactgccagagccaggcctgcaccagtcactcccgcttcaaccccagcgagtcgtccacctactccaccaatgggcagaccttctccctgcagtatggcagtggcagcctcaccggcttctttggctatgacaccctgactgtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaaccagcagggctccagcgggggagcggttgtctttgggggtgtggatagcagcctgtacacggggcagatctactgggcgcctgtcacccaggaactctactggcagattggcattgaagagttcctcatcggcggccaggcctccggctggtgttctgagggttgccaggccatcgtggacacaggcacctctctgctcactgtgccccagcagtacatgagtgctcttctgcaggccacaggggcccaggaggatgagtatggacagtttctcgtgaactgtaacagcattcagaatctgcccagcttgaccttcatcatcaatggtgtggagttccctctgccaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgccgcctagacttgctgcctcgacacgtgggctcccctcttcctcttgaccctgcaccctcctagggcattgtatctgtctttccactctggattcagccttctttttctggactctggactttctctaataataaatagttcttcttta

SEQ ID NO: 23644 - DNA, 382 bp, Homo sapiens
cttcactccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctcccctcttcctcttgaccctgcaccctcctag

SEQ ID NO: 23645 - DNA, 1137 bp, Homo sapiens
cttcactccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaaccagcagggctccagcgggggagcggttgtctttgggggtgtggatagcagcctgtacacggggcagatctactgggcgcctgtcacccaggaactctactggcagattggcattgaagagttcctcatcggcggccaggcctccggctggtgttctgagggttgccaggccatcgtggacacaggcacctctctgctcactgtgccccagcagtacatgagtgctcttctgcaggccacaggggcccaggaggatgagtatggacagtttctcgtgaactgtaacagcattcagaatctgcccagcttgaccttcatcatcaatggtgtggagttccctctgccaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgccgcctagacttgctgcctcgacacgtgggctcccctcttcctcttgaccctgcaccctcctagggcattgtatctgtctttccactctggattcagccttctttttctggactctggactttctctaataataaatagttcttcttt

SEQ ID NO: 23646 - DNA, 1152 bp, Homo sapiens
cttcactccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctccaacttgtgggtgccctctgtctactgccagagccaggcctgcaccagtcactcccgcttcaaccccagcgagtcgtccacctactccaccaatgggcagaccttctccctgcagtatggcagtggcagcctcaccggcttctttggctatgacaccctgactgtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaacctggtcctggagtcttctggtctaggtccactgctgacccctagcagagcagctccacccagctccacactccagctaccagagaagcctctggaacaaacatggaatatccttacccccttcaccaagaccctacctgtctccaatctcagcagaaaagtaacaagctgggccggggtggggatcccggtgacatgtctaccagaggcaggaagcggaggggagaggagagcagagtgtgggctgggggtcccaaccactaggggaccccccagaagtcagcatcattcgggagcctgaggcgctgggaattccaaggcctggccagaaagccccagtctaagggacgcatcccagtccccagggagccccaatctaagggatacagccccatcctcagggagccccagtctgagggagacacagactcgtcctca

SEQ ID NO: 23647 - DNA, 821 bp, Homo sapiens
ctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 23648 - DNA, 302 bp, Homo sapiens
catccctctggctccagagctcagagccacccacagccgcagccatgctgtgcctcctgctcaccctgggcgtggccctggtctgtggtgtcccggccatggacatcccccagaccaagcaggacctggagctcccaaaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagccccctgctggctc

SEQ ID NO: 23649 - DNA, 850 bp, Homo sapiens
ggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 23650 - DNA, 735 bp, Homo sapiens
catccctctggctccagagctcagagccacccacagccgcagccatgctgtgcctcctgctcaccctgggcgtggccctggtctgtggtgtcccggccatggacatcccccagaccaagcaggacctggagctcccaaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactgcaaggcctctggagctccccagctctcatggaagccccaggggcccaggactgacccagcctcttccacagccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 23651 - DNA, 465 bp, Homo sapiens
ctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggatggagtctcgctctgtcaccaggctggagtgcagtg

SEQ ID NO: 23652 - DNA, 826 bp, Homo sapiens
tgtcccggccatggacatcccccagaccaagcaggacctggagctcccaaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactgcaaggcctctggagctccccagctctcatggaagccccaggggcccaggactgacccagcctcttccacagccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgtcctgtctggatgcgcagccactgctgggtgtgggattcagggacgagggcctggggtcggggcaggcccaggccaccgcctggcagaaccggagctcctacagacccatgggcagcttctggtggagaaaatacctcaagtttcttatctacaaaacaaaagggtccactttcacaaa

SEQ ID NO: 23653 - DNA, 629 bp, Homo sapiens
ccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctagtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgtcctgtc

SEQ ID NO: 23654 - DNA, 575 bp, Homo sapiens
tgagatcatgcagggattcatcagggctttcaggcccctgcccaggcacctatggtacttgctggacttgaaacagatggaagagccgtgccgtttctagatggagtctcgctctgtcaccaggctggagtgcagtggcacaatctcagctcactgcaacctcgacctcctgggttcaagcgattctcctgcctcaaccccccgagttgctggaaccacaggcgtgtgccaccatgcccagctaatttttgtatttttaatagaaacggggtttcaccatgttggccacgatggtctcaatctcttgacctcatgatccccccgctttagcctcccaaagtgctgggatttcagtgccacattcttaagggggtgtcctcaagcccaccacatccttccagggctcccccgaaacaccctgctcttcctccctctacttaagtgacctgtaaacccaacagctcacctccgcctccaggaagaccagactcccacccttccacacctccagagcagtgggacttcctcctgccctttcaaagaataaccacagctcagaagacgatgacgtggtc

SEQ ID NO: 23655 - DNA, 990 bp, Homo sapiens
catccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgtcctgtctggatgcgcagccactgctgggtgtgggattcagggacgagggcctggggtcggggcaggcccaggccaccgcctggcagaaccggagctcctacagacccatgggcagcttctggtggagaaaatacctcaagtttcttatctacaaaacaaaagggtccactttcacaaa

SEQ ID NO: 23656 - DNA, 838 bp, Homo sapiens
agcatccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 23657 - DNA, 3146 bp, Homo sapiens
gtggcctaggcggggcttccttctggacgccacctcacaacgtgtgttgctttccgctcctcggaacatccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgaccggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgctttaaattttggagctttcataaatgttcaatgcattttaagtgtgtggcttataaatattttggtatttttctatactacgtaaattctgagtttaaatgtcatacacaaatactaagacactttgcatttttaaaaattaagaatcatttgtgaagtccactacgaggtacttcaaaagcccagtaatggtggtcagataccatgtagatggatacagattgttgactcttttgaagttgtttttttcttatattttatattaccattaaccaataaaatctggcagaaagtctgctattccattggtaa

SEQ ID NO: 23658 - DNA, 1186 bp, Homo sapiens
tttcgcacagcaaaagttgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgctttaaattttggagctttcataaatgttcaatgcattttaagtgtgtggcttataaatattttggtatttttctatactacgtaaattctgagtttaaatgtcatacacaaatactaagacactttgcatttttaaaaattaagaatcatttgtgaagtccactacgaggtacttcaaaagcccagtaatggtggtcagataccatgtagatggatacagattgttgactcttttgaagttgtttttttcttatattttatattaccattaaccaataaaatctggcagaaagtctgctattccattggtaaa

SEQ ID NO: 23659 - DNA, 1547 bp, Homo sapiens
ctcacaacgtgtgttgctttccgctcctcggaacatccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgaccggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaaaaaaagaaaaaagaaa

SEQ ID NO: 23660 - DNA, 1911 bp, Homo sapiens
tagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccacta

SEQ ID NO: 23661 - DNA, 1682 bp, Homo sapiens
atccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgtcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccact

SEQ ID NO: 23662 - DNA, 3783 bp, Homo sapiens
cacactagaatttcaaggtgtgagaggctaaaagacgtccaagtacatgaaacagaacctgcaaataagagtgaatgacgaatagaaagaccacctcaacctgtccacttccctacggccgcagaagttatgattcaaggaataatgagactctaaatcctttaaaattctacaagagcagcctttgccaaacccagcggggagtggctgctcggtgccagcgcgaggagcacgtagactgccgatgccagagaagcccggtgcgggttccgtgctttctctccgttccaggaagaccccagctcgtggccaaatcttcttgccgcttcccggtctgcgcgcctacgctgccggtttcccgacaaaagcgacggcgccctggtgaaaagcagacgcccctcatcggtttgcgccttgcagctcaactatgccccagcctcccacaagccacctgcccgcgtcctccgccaggcgtccagcccggacctgcccccgcggccgccaaggcgcacgtgaagctcccgggcggggggagcgcaaggaggcgggagtttgcggacgcgaacgcaggcctaggaagggaagcgattccagggcgcacgcgcagagcctggagactgggcggggcgtgcctcccgcaggggttacgaacgaaaggcgagcgcgtggcgctcaggagcccgcgcacgcgctgtggtctcgccccgcccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagaaaaaattatgcggtctgttaagaaaaatgagtaatttgtgttttggacttgaaataaacagtgttctgtagataattcctcaacttca

SEQ ID NO: 23663 - DNA, 2708 bp, Homo sapiens
gaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagaaaaaattatgcggtctgttaagaaaaatgagtaatttgtgttttggacttgaaataaacagtgttctgt

SEQ ID NO: 23664 - DNA, 3785 bp, Homo sapiens
actttttcacactagaatttcaaggtgtgagaggctaaaagacgtccaagtacatgaaacagaacctgcaaataagagtgaatgacgaatagaaagaccacctcaacctgtccacttccctacggccgcagaagttatgattcaaggaataatgagactctaaatcctttaaaattctacaagagcagcctttgccaaacccagcggggagtggctgctcggtgccagcgcgaggagcacgtagactgccgatgccagagaagcccggtgcgggttccgtgctttctctccgttccaggaagaccccagctcgtggccaaatcttcttgccgcttcccggtctgcgcgcctacgctgccggtttcccgacaaaagcgacggcgccctggtgaaaagcagacgcccctcatcggtttgcgccttgcagctcaactatgccccagcctcccacaagccacctgcccgcgtcctccgccaggcgtccagcccggacctgcccccgcggccgccaaggcgcacgtgaagctcccgggcggggggagcgcaaggaggcgggagtttgcggacgcgaacgcaggcctaggaagggaagcgattccagggcgcacgcgcagagcctggagactgggcggggcgtgcctcccgcaggggttacgaacgaaaggcgagcgcgtggcgctcaggagcccgcgcacgcgctgtggtctcgccccgcccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagaaaaaattatgcggtctgttaagaaaaatgagtaatttgtgttttggacttgaaataaacagtgttctgtagataattcctcaa

SEQ ID NO: 23665 - DNA, 3297 bp, Homo sapiens
tgaattcaaaacagttactctgaatggtctttgctaagaacaatttaatgattaagtaaggtcagtgtccttggaagtccaaactctagccagatttccctggtctacacccctagggataaggtaaatgtttaagcacacagtgaacttcctgaggcccccaaatctaatggaactagctattgagggctaaaagaggatggtttttttagaaaactcgaagcaaatctctcaggctggggatatttcaaagactactactattattattaataacaattgcaatatttgttgagtccctaaatgaagctaaaactttgttctaataaatttaatctttacagcaacctatgaggtagataatattgtcattcccatgagggagctaaggatcagagaaggtaagtcacttgtctaaggtcacatagctagcatgttatgcaatcaggagtcaaacctggtttgtctgaatctgaagtccatctgctctgtgcacttttataccgtctgctttttcctttattcctaaccttcttccattctgattcccactgagtagtggacaggaaccactgaagtttgcctgacaccatcaaccaggccctagtcacctggctttgcctttgccctgctgtgtgatcttagctccctgcccaggcccacagccatggccatggcccagaaactcagccacctcctgccgagtctgcggcaggtcatccaggagcctcagctatctctgcagccagagcctgtcttcacggtggatcgagctgaggtgccgccgctcttctggaagccgtacatctatgcgggctaccggccgctgcatcagacctggcgcttctatttccgcacgctgttccagcagcacaacgaggccgtgaatgtctggacccacctgctggcggccctggtactgctgctgcggctggccctctttgtggagaccgtggacttctggggagacccacacgccctgcccctcttcatcattgtccttgcctctttcacctacctctccttcagtgccttggctcacctcctgcaggccaagtctgagttctggcattacagcttcttcttcctggactatgtgggggtggccgtgtaccagtttggcagtgccttggcacacttctactatgctatcgagcccgcctggcatgcccaggtgcaggctgtttttctgcccatggctgcctttctcgcctggctttcctgcattggctcctgctataacaagtacatccagaaaccaggcctgctgggccgcacatgccaggaggtgccctccgtcctggcctacgcactggacattagtcctgtggtgcatcgtatcttcgtgtcctccgaccccaccacggatgatccagctcttctctaccacaagtgccaggtggtcttctttctgctggctgctgccttcttctctaccttcatgcccgagcgctggttccctggcagctgccatgtcttcgggcagggccaccaacttttccacatcttcttggtgctgtgcacgctggctcagctggaggctgtggcactggactatgaggcccgacggcccatctatgagcctctgcacacgcactggcctcacaacttttctggcctcttcctgctcacggtgggcagcagcatcctcactgcattcctcctgagccagctggtacagcgcaaacttgatcagaagaccaagtgaagggggatggcatctggtagggagggaggtatagttgggggacaggggtctgggtttggctccaggtgggaacaaggcctggtaaagttgtttgtgtctggcccacagtgactctctgtgcacgactcaactgccaagggcatcactggccaattcttggatttagggattggctaggagttgctggggtccactcctgggcctgccccagctccttgcccagggagagggaaagagttaacggtgtgggccactccagcttgcccttccactgccactcactggggtgaggctgggggtcagcttggtgaggattggggcttctagattgtctaggcaggaggtgaaacttaggccagagtcagatttgagctgagccaggggaggccttggcaacctacttctactcagatttcattgctggatgcggaaggggtaggcccaaaatatatacaggatcttactgtcccttgaagcccagccacaagtgttggagctgcagagagaccccaaaggtagtagattgtgccagatacaaatgggtcccatccagtgcttcatactccttcagtcactatcccagacagtgagccccagatctcctagctctggcttctgtgtcccacacggcctgttcccagcttctctcctggttcccttgttacggattcatttatccattcagtgtttcctgggcctctgctcagaggcaggtcaccactgggccctgtggatcaatgcaagatgacaaaggctttttttttttttttttttttttttttttttgaggagtttcgctcttgttggctaggctggagtaaaatggtgcgatctcggctcactgcacctccgcctcccaggttcaagcgattttcctgcctcagcctcccgagtagctggggttacaggcatgcaccaccatgcctggctaattttctgtatttttagtagagacggggtttctccatgttggtcaggctggtcttgaactcctgacctcaggtgatctgcccgtctcggcctcccaaagtgctgggattaccggcatgagccactgcgcctggccgacaaaggctttgatatcagaatgaactgtcaagggaggtgctggagagggattaacctgtgctgcctgggaccctcagggtcttaggttggggagtgtgaataggagtttgcagatggagaataggaagggcattccaggcagagggaaacctgtgcagagaccaagaggtgtggaaggaaaagtggggttggggctgggtggtctggattatggcctggatgcaataaagtactgtgacagtagccacctctttgttttttgtctcctgtttccgggaggggcccctgctcacattactggaggttttccggaggaagctggggcccctgggagtggacacagggtgcagggagcagttcttgttttatctttgctgggggatggggttggggccttatataccatatctatatatacaaaatttgtttggcaagggagtgggcggcagttttattactaaagttttataagtagttaaaataatgtgtttaaaatatgataatcccactttatgatctga

SEQ ID NO: 23666 - DNA, 2114 bp, Homo sapiens
acagtttcccttccgctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaagga

SEQ ID NO: 23667 - DNA, 1956 bp, Homo sapiens
agtttcccttccgctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaagga

SEQ ID NO: 23668 - DNA, 2067 bp, Homo sapiens
aagtcagtgcctcagttgctggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcggaagaggagcactggaagaaggaagagacaaatgttggggtctacggattcagttccagtttaatgatgtggccctctaaggagataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaatgcatatatatatgtgtgtatatatatatatatatatatatatatgaacagaagaccaagacaacttggtgtaatgtctaaaaaacttctaatgggagcttatcagcagtttatcaaataataaagcaagaatttctatttttgtccttaatcactttggacacagagtagtcaatggaaatatttttgttaattacttataaggtactgagtatttttatatgatttccaacctgttttaaacgacttatgagtaagagatagcattttctagtgtttttgcactataatgccactttttgaactcttgtgacaaatgtagatttgactcttaaaaattaagcctttcgtatactgggccctcataagctttgcacaattttttcccaaaaaatagccacaattaatagtaatttgaagctatatcaacggttggattgaaattgtcatgagtgttaatattatatacactcttcaactaggtacagttttatttcaccatagagaagttttaaggaaattatgtatcaagtgttcatgttaagtggtttcatttttcaattataaaataaagggaaaaaatcagaa

SEQ ID NO: 23669 - DNA, 934 bp, Homo sapiens
aggttggcccctggtgccccgggagaggggacagggcggatgtgcctggggtggggtcctttgaaggtgtggcttcggaccgagaggtgaggctgctgttttccccctgctttatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaatttt

SEQ ID NO: 23670 - DNA, 715 bp, Homo sapiens
gggacagggcggatgtgcctggggtggggtcctttgaaggtgtggcttcggaccgagaggtgaggctgctgttttccccctgctttctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataa

SEQ ID NO: 23671 - DNA, 585 bp, Homo sapiens
gaagtgaagtcagtgcctcagttgctgaggagcactggaagaaggaagagacaaatgttggggtctacggattcagttccagtttaatgatgtggccctctaaggagataattttgccttaaacagaaagacttgaccctcttaggtgtcatacctaagctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcc

SEQ ID NO: 23672 - DNA, 1026 bp, Homo sapiens
gggtccttccggcgtcgccggagtgaattgatccgggagttgaagagggctgcaaggtgggaagtgaagtcagtgcctcagttgctgaggagcactggaagaaggaagagacaaatgttggggtctacggattcagttccagtttaatgatgtggccctctaaggagataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctt

SEQ ID NO: 23673 - DNA, 1360 bp, Homo sapiens
gcacgactccggctgggcaggattccggacaacgcctggttcctcttgggtccttccggcgtcgccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgt

SEQ ID NO: 23674 - DNA, 849 bp, Homo sapiens
ggcggatgtgcctggggtggggtcctttgaaggtgtggcttcggaccgagagctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaactt

SEQ ID NO: 23675 - DNA, 716 bp, Homo sapiens
gaaggtgtggcttcggaccgagagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaagtaagtactgtaatttatc

SEQ ID NO: 23676 - DNA, 686 bp, Homo sapiens
gtgggaagtgaagtcagtgcctcagttgctgggaagaggagcactggaagaaggaagagacaaatgttggggtctacggattcagttccagtttaatgatgtggccctctaaggagataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatata

SEQ ID NO: 23677 - DNA, 1276 bp, Homo sapiens
cggctgggcaggattccggacaacgcctggttcctcttgggtccttccggcgtcgccggagtgaattgatccgggagttgaagagggctgcaaggtgggaagtgaagtcagtgcctcagttgctgatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatct

SEQ ID NO: 23678 - DNA, 6453 bp, Homo sapiens
ggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccctcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccagcacagcccgtccaagaaagccctttataacaaacacctccctgaagggaagctgctcacagccagggtcctacgccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggaagctggtgaactctacaaccggatgctgaagcgtttccggcaggagaaagctgtgtggatcaaatacggcgccttccttctgcggaggagccaggctgcagccagtcaccgcgtgctgcagcgagccctggagtgcctgcctagcaaggagcatgtggatgtcattgccaagtttgcccagcttgagtttcagctgggggatgcagagcgggccaaagccatttttgagaacacgctgagcacctacccaaagcgcacagatgtctggtcggtctatatcgacatgaccatcaagcacggcagccagaaggacgtccgggacatctttgagcgggtcattcatctgagcttggcccccaagagaatgaagttcttcttcaagcgctacctggactacgagaagcagcatggcactgagaaggatgtgcaggcagtcaaggccaaggccctggagtatgtggaggccaagagctcagtgctagaggactagtggcaggctggctctgtgggacactgtcaacaatgggccagcccggccccgcctcgagtgcctgggcactcggaaaactgttacctcaggactctatttaaatgctgctttttctgcagcacgcttggggaaatcctgtcaggatgaaaaggaagttgagattttttaaatccctcttcgcttgctttattttcagtaccaacttgttatctttttccttatctgaggctacctggggattgtgggcagcaggcccctggactcccagaaatgctgagggtccctcttccaggggagttccctggggagcaagagtagaggggctattcccgagggtcctgtggtcagggtcctgctttgtccctggcaggctgtcagtccagctggagggggtcagtaggctccagggagtgggccctcccctccgatcttggagtctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggca

SEQ ID NO: 23679 - DNA, 3789 bp, Homo sapiens
gggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgcagataaagaaaagcaagaaa

SEQ ID NO: 23680 - DNA, 936 bp, Homo sapiens
atggctgccgccggggccaggcctgtggagctgggcttcgccgagtcggcgccggcgtggcgactgcgcagcgagcagttccccagcaaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaa

SEQ ID NO: 23681 - DNA, 2657 bp, Homo sapiens
gggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatacttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatcggtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagtagccaacatttatccagcacttaccttatataaagggctgtttgtgcatgagctcattaaaatcgtgacagcagaccaatgagtgagaaactgccccattttgaaggtgaggaaattgaggttctgggtataactttctttggtcacataatattaaattttacaatttgagccttgagccatacacaaaaccaccacaaaattagatttatagactcaaaatgaaaacatcagcttactggtttgtagttcataccagtcatacattccaaaacatgttttgagtcttactctgtgcctgaccttgtgcttgataacagggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattactagactgttgcttttattttgagatggttgtgtgtgtattggggggaaaggaaacgagtaattatgttggtgttactgagaactgagatgttgggcgtaggaggaagataatgttgattgtgtctacgtaccatttctctctaaaaggaactccaggctctttggagaggtggttgattccagaactaggtcaggaaacgttcatataatgtgggaacatggtcatatcaaagattaaggataaggattactagggccatgtcagaactcaagcaacatgaaaaggctcctgcttgcaaaagatggacagtttgaacatccacaaggacgctaactgcatcagatatgtttaatgggttcaaaatgatactttaaaaaaactcagtaatcatctttataggatacttgggaacagactcattttcaaattggtaaataaaaggaaagagtttgccttcgaggggtacataacttaattatgaatgaagtgatatgtgtggaatttacttcagagtaatggaggtggaagtggcagagaaaggaaacactggacttgatagtgttgaaactgattaatgatatgtggcggttcattatagtatttccacttttctgtatgtccaaaattttctaaaataaaaggagaattgaatagaaaaa

SEQ ID NO: 23682 - DNA, 3378 bp, Homo sapiens
tcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacagattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccagcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaatatcctttggcaatttcagatatcacagcaaaaaaaaaaaaagttccaagtgtttttggcaa

SEQ ID NO: 23683 - DNA, 1897 bp, Homo sapiens
cttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatacttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatcggtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagtagccaacatttatccagcacttaccttatataaagggctgtttgtgcatgagctcattaaaatcgtgacagcagaccaatgagtgagaaactgccccattttgaaggtgaggaaattgaggttctgggtataactttctttggtcacataatattaaattttacaatttgagccttgagccatacacaaaaccaccacaaaattagatttatagactcaaaatgaaaacatcagcttactggtttgtagttcataccagtcatacattccaaaacatgttttgagtcttactctgtgcctgaccttgtgcttgataacagggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaa

SEQ ID NO: 23684 - DNA, 1114 bp, Homo sapiens
tgtgggctgcgccccacgccagcccgcgccccgcatggctgccgccggggccaggcctgtggagctgggcttcgccgagtcggcgccggcgtggcgactgcgcagcgagcagttccccagcaaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattactaga

SEQ ID NO: 23685 - DNA, 6161 bp, Homo sapiens
agtacttctccggggggttgttcgagtggaggaatactcttacgtgaaagtgctcagtacaccactgcggcaggaaggaggaagggaagaattccagatggggagaaagtaatattttgcagcacagtacagggtaaactgggtccaggtgggcgtagccgccgcgacaccttcacgtgaccgcggacagcttaaggaccccgcatccagtgcgcctgcgctggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaaggaggtgttccctgtcttggctgcaaagcactgtatcatgcaggccaatgctgagtaccatcagtctatcctggcaaaacagcagaagaaatttggagaagaaattgcaaggttacagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccactttggcaaatggggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgagtcattaaggttgttggatgaagaagaagcaaccgataatgatttaagagcaaaatttaaggaacgttggcaaaggacaccatccaatgaactgtataagcctttaagagcagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggagtattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttacttcatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattctt

SEQ ID NO: 23686 - DNA, 5954 bp, Homo sapiens
ggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaagtatttttatttccaggaggtgttccctgtcttggctgcaaagcactgtatcatgcaggccaatgctgagtaccatcagtctatcctggcaaaacagcagaagaaatttggagaagaaattgcaaggttacagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccactttggcaaatggggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgagtcattaaggttgttggatgaagaagaagcaaccgataatgatttaagagcaaaatttaaggaacgttggcaaaggacaccatccaatgaactgtataagcctttaagagcagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggagtattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttacttcatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattctt

SEQ ID NO: 23687 - DNA, 2851 bp, Homo sapiens
ctcatgaggagccactcagattcctgtcacttctcaaagcatctccgtcgtgaacatggccctgccaccattcttcggccagggtcgcccaggcccaccgcccccgcagccgccgcctcctgctcctttcggctgtccgccaccgccgctgccctccccggctttcccgccgcctctcccccagcggcccggcccttttccgggggcctccgcccccttccttcagcctccgctggctctgcagccccgagcctccgcggaggcctcccgcggcggaggcggcgctggcgccttctacccggtgccaccaccgccgctgcctcctccgccgccccagtgtcggcccttcccggggaccgacgccggcgagcggccgcggccaccgcctcccggcccggggccgccctggagcccgcggtggcctgaggcgccgccgccgccggccgacgtgctcggggatgcggccctccaacgcctgcgcgaccggcagtggctggaggcggtgttcgggaccccgcggcgggcaggctgtccggtgccccagcgcacgcatgccgggcccagccttggcgaagtgcgcgcgcgattgctccgggctctgcgcctggtgcggcggctgcgcggcctgagccaggccctgcgcgaggccgaagccgacggcgcggcctgggtcctgctgtactcccagaccgcgccgctgcgcgcggaactggccgagcggctacagccgttgacccaggctgcctatgtgggcgaggcgcggaggaggctggagagggtccggcgccgccggctgcggcttcgcgagagggcccgggaacgcgaggccgagcgggaggcagaggccgcgcgggcagtggaacgcgagcaggagattgaccgctggagggtgaagtgtgtgcaggaggtggaggagaagaagcgggagcaggaactcaaagcagccgctgatggcgtactatctgaagtgaggaaaaaacaagcagataccaaaagaatggtggacattctacgggctttggagaaattgaggaaactgaggaaagaggctgcagcgaggaaaggggtctgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaagaaacaaagaaaagaaaaagagaaaattttacttcagaaacgtgaaattgagtccaagttgtttggggatccagatgagttcccacttgctcacctcttggagcctttccgacagtattatctccaagccgagcactccctgccagcgctcatccagatcaggcatgattgggatcagtacctggtgccatccgatcatcccaaaggcaacttcgttccccaaggatgggtccttcccccgctccccagcaacgacatctgggcaactgctgttaagctgcattagtaaagatgctccaggagtgtggtccagccagcgctctttccagctgtaaatattagcgatggtgccatcttttgctgtagactaaactgcaacttctaaattccatgtggcattcccctaccctgaagttatgctttccttctgtgctctgtgctggccagaggtgcctcttgaatcagattaatgtggtttttcaggaaaggacttaggtgaactgaggtttttaccacaggcagtgaatgaccttggttcaccaaatttgcctctgttttgaggggcttggtccagagtgacttgttaatttactctaacttccttgtgtgttgatgggtaagtacactcaaacactgaatacaggtgtgtgatgggtagatttcacagcccttctactaatagtgagtgtgaaggcaagcttgatgcaaaacctcctgacctttcctacctgaagagccctttgacttctaggaagaaaggtcaaaaatgttatcttcagttgtgttaatcccagttttagtgcagcttaggaggctgctagttaggaagatggcagtggctgtaggctgggttgccagaaaagatggtggcctagtcttattattcagatggagaacttagaaaacctgaagagtacccaaattggattgtattttaatggacaatggctgtattttttccatgttagaaggatcctaatgaaagcacctgttatttttaagtttctaagggtctagttgttcagaatccccaaggatatttccctaacctcactcagtcacattgtaggagccagtgtagctatggaattatcttaggaactcaagcttctaaaactatccatgtagtcaaatctaggggaaaaagcaaataaaaatagtaaaatttggccgggcacagtggctcacgcctgtaatcccaacactttgggaggccgaggcgggccgatcacgaggtcaggagatcaaggccatcctggctaacacggtgaaaccctgtctctactaaaaatacaaaaaaatattagctgggcgtaggtggtgcacacctgtagtcccagctactggggaggctgaggcaggagaatggtgtaaaacccaggaggcagagcttgcagtgagccgagatcgcgccacggcactccagcctgggagacagagcaagactccgtctcaaaaaaaaaaaaagtaaaatttattttttatattcattaataaatgctgttgtgcttggagatgatcactcatataacatgtcatttttttggttctgttttggtttggtttttgccaattattttgttatatttccaaaaaactaaataaaaatcatttttatttttta

SEQ ID NO: 23688 - DNA, 934 bp, Homo sapiens
ctcatgaggagccactcagattcctgtcacttctcaaagcatctccgtcgtgaacatggccctgccaccattcttcggccagggtcgcccaggccccctccgcccccttccttcagcctccgccggcttcgcgagagggcccgggaacgcgaggccgagcgggaggcagaggccgcgcgggcagtggaacgcgagcaggagattgaccgctggagggtgaagtgtgtgcaggaggtggaggagaagaagcgggagcaggaactcaaagcagccgctgatggcgtactatctgaagtgaggaaaaaacaagcagataccaaaagaatggtggacattctacgggctttggagaaattgaggaaactgaggaaagaggctgcagcgaggaaaggggtctgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaagaaacaaagaaaagaaaaagagaaaattttacttcagaaacgtgaaattgagtccaagttgtttggggatccagatgagttcccacttgctcacctcttggagcctttccgacagtattatctccaagccgagcactccctgccagcgctcatccagatcaggcatgattgggatcagtacctggtgccatccgatcatcccaaaggcaacttcgttccccaaggatgggtccttcccccgctccccagcaacgacatctgggcaactgctgttaagctgcattagtaaagatgctccaggagtgtggtccagccagcgctctttccagctgtaaatattagcgatggtgccatcttttgctgtagactaaactgcaact

SEQ ID NO: 23689 - DNA, 2150 bp, Homo sapiens
agccactcagattcctgtcacttctcaaagcatctccgtcgtgaacatggccctgccaccattcttcggccagggtcgccccggcgccgccggctgcggcttcgcgagagggcccgggaacgcgaggccgagcgggaggcagaggccgcgcgggcagtggaacgcgagcaggagattgaccgctggagggtgaagtgtgtgcaggaggtggaggagaagaagcgggagcaggaactcaaagcagccgctgatggcgtactatctgaagtgaggaaaaaacaagcagataccaaaagaatggtggacattctacgggctttggagaaattgaggaaactgaggaaagaggctgcagcgaggaaaggggtctgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaagaaacaaagaaaagaaaaagagaaaattttacttcagaaacgtgaaattgagtccaagttgtttggggatccagatgagttcccacttgctcacctcttggagcctttccgacagtattatctccaagccgagcactccctgccagcgctcatccagatcaggcatgattgggatcagtacctggtgccatccgatcatcccaaaggcaacttcgttccccaaggatgggtccttcccccgctccccagcaacgacatctgggcaactgctgttaagctgcattagtaaagatgctccaggagtgtggtccagccagcgctctttccagctgtaaatattagcgatggtgccatcttttgctgtagactaaactgcaacttctaaattccatgtggcattcccctaccctgaagttatgctttccttctgtgctctgtgctggccagaggtgcctcttgaatcagattaatgtggtttttcaggaaaggacttaggtgaactgaggtttttaccacaggcagtgaatgaccttggttcaccaaatttgcctctgttttgaggggcttggtccagagtgacttgttaatttactctaacttccttgtgtgttgatgggtaagtacactcaaacactgaatacaggtgtgtgatgggtagatttcacagcccttctactaatagtgagtgtgaaggcaagcttgatgcaaaacctcctgacctttcctacctgaagagccctttgacttctaggaagaaaggtcaaaaatgttatcttcagttgtgttaatcccagttttagtgcagcttaggaggctgctagttaggaagatggcagtggctgtaggctgggttgccagaaaagatggtggcctagtcttattattcagatggagaacttagaaaacctgaagagtacccaaattggattgtattttaatggacaatggctgtattttttccatgttagaaggatcctaatgaaagcacctgttatttttaagtttctaagggtctagttgttcagaatccccaaggatatttccctaacctcactcagtcacattgtaggagccagtgtagctatggaattatcttaggaactcaagcttctaaaactatccatgtagtcaaatctaggggaaaaagcaaataaaaatagtaaaatttggccgggcacagtggctcacgcctgtaatcccaacactttgggaggccgaggcgggccgatcacgaggtcaggagatcaaggccatcctggctaacacggtgaaaccctgtctctactaaaaatacaaaaaaatattagctgggcgtaggtggtgcacacctgtagtcccagctactggggaggctgaggcaggagaatggtgtaaaacccaggaggcagagcttgcagtgagccgagatcgcgccacggcactccagcctgggagacagagcaagactccgtctcaaaaaaaaaaaaagtaaaatttattttttatattcattaataaatgctgttgtgcttggagatgatcactcatataacatgtcatttttttggttctgttttggtttggtttttgccaattattttgttatatttccaaaaaactaaataaaaatcatttttatttttt

SEQ ID NO: 23690 - DNA, 1994 bp, Homo sapiens
aggacagacggcagtggctcctgagagctggctggggccattttggcccctcgcctgtggccttctgcagacttggcctgggaggggatggggcagctgcgccatgtgcaccacccttttcctgctcagcaccctggccatgctctggcgccgccgatttgccaaccgagtccaaccagagcccagcgacgtggatggggcagctaggggcagcagcttggatgcggaccctcagtcctcaggcagggagaaagaacctctgaagtaagccctcacctctgcaggtggggctcaggcccagagactgggatcagctggctcaggcagctcaggtcctggttcgtcccctagcccaggaggatgctgtgggagctgcagcagcggcaagagggagaatggggggaagcagcactagagaagttcccagagctcatcctgtcactggctgctctgctgaaattatcaataagaaatgccagttggatctgtgacatgtctgcctgcagctggatgggagcaacggacagcttgtcctccgaatgtgttttctgtatgtgtgcaagcgcgtgtgttccaaacgggcagtagcgtgtgggaaggaaaaagcctgacacttgtttttatcaatttgctgatgctcagtcccggcggctgcctcctttgcccccagctgctctgccatttctctcttttcaatcctgcatgatcctgagcagagataaaagcagatttccgcttctgctcccagatccaggagcagaccctgcaggcagctgctcctgatgtctcacagctattagtcttcaaaaaccccccgtgcctctgtgcacacgcgtctctcctccccagccagcccccctcccagcccagcggcgatgtctctgcctggctggcccgtgcccttgacttccaggcagtagaagatggagttctctagacagcagcacttcagccgccactctgcctctgaagggaaggaagggaaagggtgagggatgccgcagagcagagggaaccgctggggaggcgctcagggtgggggaggaggtgcaccccgctggggagggcctgctggtacctcggggagcctggctggggtgtgtgcgaaggcagttctgtgggagcctctcaaagtagggcaggcaggaggcagggggaaagtcacactagggaaggagcctgcagaggcaaagccagagcgccagcctgacccaggccgtgagcccgtgatcgcctgtctcagctcctgtcagcctgtctctctctttggaggcatcggccttcctggtgacaggcctgtcaggctgagggccagagggcactgttcccgggacccagtctgtgttccccgatcctatctgcatttattctctatttgccatgttcctgtcacctcatccttgctgccatttccgagttgctcatctccttccactggtctgaggaattgtcaggccaaggtcatggagctggctcacggcccagacgcacttccccagggcagcgcccctccacgccactgttccgagaacctgcgcaggaggtggtggctgctccagggatccatccagaggaagggcgggaaaaagagaggaaggggctgctggcggccagcggggctgtggctgcctgggcttggaggttgcctgggcagctggggtgccatgtgggccgggtgggggggctgtctcccccagggagcaggctggctttggtgggagcagattgtgtttacaccttccccgcacacccagcccacgctcgcctcttattcccggggcctctcccacccctgggctctctgcgcagtctgcacatttgcagctcctgctgcagaaagttacctctctcagcctagagctccccacagaaggctcctgggacccgggtgccccttccttggcccactggctcccatcacagggcttagtgtgaagctcagggcaagggtggacctttaaatgggggaattaaatcctgactatgacactgtc

SEQ ID NO: 23691 - DNA, 1177 bp, Homo sapiens
ggtcccagtgcttgcggcgtcgcgagtgtgcgcgtgcggacccttcccgcggcggggaactgactcaaagtccaacactcccgagctttcgcggcgaggccgaccgccagcccgcccgtgggggcgaacaggagcccctccggcggccgccgtggacctagctgggctcccctcgcccgggcctctccccgcgcccccgagccagccgctgggggccgcggcgccactcccacggctctggacgcccaggctctggggggttagcacgggggtcgtccccctgcccgcccaccgccccggctgtcggaacttgagcgcacctccgacctcgggcgccagaggcctgcgccccctctccttccgcccagcacctccatgccctcggtgcacgaacgcggcggcggcggccagaagtcccccgtggcttatgaatgacacggacagagagcccagcgacgtggatggggcagctaggggcagcagcttggatgcggaccctcagtcctcaggcagctcaggtcctggttcgtcccctagcccaggaggatgctgtgggagctgcagcagcggcaagagggagaatggggggaagcagcactagagaagttcccagagctcatcctgtcactggctgctctgctgaaattatcaataagaaatgccagttggatctgtgacatgtctgcctgcagctggatgggagcaacggacagcttgtcctccgaatgtgttttctgtatgtgtgcaagcgcgtgtgttccaaacgggcagtagcgtgtgggaaggaaaaagcctgacacttgtttttatcaatttgctgatgctcagtcccggcggctgcctcctttgcccccagctgctctgccatttctctcttttcaatcctgcatgatcctgagcagagataaaagcagatttccgcttctgctcccagatccaggagcagaccctgcaggcagctgctcctgatgtctcacagctattagtcttcaaaaaccccccgtgcctctgtgcacacgcgtctctcctccccagccagcccccctcccagcccagcggcgatgtctctgcctggctggcccgtgcccttgacttccaggcagtagaagatggagttctctagacagcagcacttcagccgccactctgcctctgaagggaaggaagggaaagggtg

SEQ ID NO: 23692 - DNA, 1832 bp, Homo sapiens
agtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcattcagagactgcccttctcacgggctctatgcctgcactgggaaggaaacaaatgtgtataaactgctgtcaataaatgacacccagaccttccggctca

SEQ ID NO: 23693 - DNA, 907 bp, Homo sapiens
gcgcagtatgtgtggttggggaattcatgtggaggtcagagtggaagcagttatcttggccccaggatgtcatccagctcctgcttccataagaagcatgtcgttcttaatacacgatgttgacaagcagtatggtgaggaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggac

SEQ ID NO: 23694 - DNA, 534 bp, Homo sapiens
tgtgtggttggggaattcatgtggaggtcagagtggaagcaggtgagaatggagggggcggcaaaggctcgtttctgggcatctctgcagtcctcctctgctccatgatgtgcactttgggcgaggagagtgcgtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactga

SEQ ID NO: 23695 - DNA, 732 bp, Homo sapiens
cagagtggaagcaggtgagaatggagggggcggcaaaggctcgtttctgggcatctctgcagtcctcctctgctccatgatgtgcactttgggcgaggagagtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaa

SEQ ID NO: 23696 - DNA, 796 bp, Homo sapiens
atgtggaggtcagagtggaagcaggtgagaatggagggggcggcaaaggctcgtttctgggcatctctgcagtcctcctctgctccatgatgtgcactttgggcgaggagagtgcgtgcgtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcga

SEQ ID NO: 23697 - DNA, 890 bp, Homo sapiens
agtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcac

SEQ ID NO: 23698 - DNA, 700 bp, Homo sapiens
ctgggcatctctgcagtcctcctctgctccatgatgtgcactttgggcgaggagagtgcgtgtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggtgagc

SEQ ID NO: 23699 - DNA, 1110 bp, Homo sapiens
tccgtatgcgcgattcctgtgcgcgaagttcgggtccgtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcccagcaggaggcccagcgggcccaattcttggtagaaaaagcaaagcaggaacagcggcagaaaattgtgcaggccgagggtgaggccgaggctgccaagatgcttggagaagcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccaggtacagtgacagcctcatcaagggtaagaaatga

SEQ ID NO: 23700 - DNA, 902 bp, Homo sapiens
gccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccaggggaagtgacagcctcatcaagggtaagaaatga

SEQ ID NO: 23701 - DNA, 1515 bp, Homo sapiens
aggaaatggagatgacttgctgtcttgcgctgccctccctgggagggcagccttccagaaaggggcgggacttccgtatgcgcgattcctgtgcgcgaagttcgggtccgtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcccagcaggaggcccagcgggcccaattcttggtagaaaaagcaaagcaggaacagcggcagaaaattgtgcaggccgagggtgaggccgaggctgccaagatgcttggagaagcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccaggggaagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctgaa

SEQ ID NO: 23702 - DNA, 1518 bp, Homo sapiens
gtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtgggtgagtcgcaagagccgtggggtgagggcttctgagatgcaggaggaggaaagactccatgggtggggctcctgacccaggacagggtctccctgactctctcccaccacagcccagcaggaggcccagcgggcccaattcttggtagaaaaagcaaagcaggaacagcggcagaaaattgtgcaggccgagggtgaggccgaggctgccaagatgcttggagaagcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccaggggaagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctgaa

SEQ ID NO: 23703 - DNA, 1338 bp, Homo sapiens
cttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaaggtccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgccagagaggtggtaaatggcagaaaggacattccccctcccctccccaggtgacctgctctctttcctgggccctgcccctctccccacatgtatccctcggtctgaattagacattcctgggcacaggctcttgggtgcattgctcagagtcccaggtcctggcctgaccctcaggcccttcacgtgaggtctgtgaggaccaatttgtgggtagttcatcttccctcgattggttaactccttagtttcagaccacagactcaagattggctcttcccagagggcagcagacagtcaccccaaggcaggtgtagggagcccagggaggccaatcagccccctgaagactctggtcccagtcagcctgtggcttgtggcctgtgacctgtgaccttctgccagaattgtcatgcctctgaggccccctcttaccacactttaccagttaaccactgaagcccccaattcccacagcttttccattaaaatgcaaatggtggtggttcaatctaatctgatattgacatattagaaggcaattagggtgtttccttaaacaactcctttccaaggatcagccctgagagcaggttggtgactttgaggagggcagtcctctgtccagattggggtgggagcaagggacagggagcagggcaggggctgaaaggggcactgattcagaccagggaggcaactacacaccaacctgctggctttagaataaaagcaccaactgaa

SEQ ID NO: 23704 - DNA, 1022 bp, Homo sapiens
gagggcgccatgaggagcctgtgctgcgccccactcctgctcctcttgctgctgccgccgctgctgctcacgccccgcgctggggacgccgccgtgatcaccggggcttgtgacaaggactcccaatgtggtggaggcatgtgctgtgctgtcagtatctgggtcaagagcataaggatttgcacacctatgggcaaactgggagacagctgccatccactgactcgtaaaaacaattttggaaatggaaggcaggaaagaagaaagaggaagagaagcaaaaggaaaaaggaggttccattttttgggcggaggatgcatcacacttgcccatgtctgccaggcttggcctgtttacggacttcatttaaccgatttatttgtttagcccaaaagtaatcgctctggagtagaaaccaaatgtgaatagccacatcttacctgtaaagtcttacttgtgattgtgccaaacaaaaaatgtgccagaaagaaatgctcttgcttcctcaactttccaagtaacatttttatctttgatttgtaaatgatttttttttttttttatcgaaagagaattttacttttggatagaaatatgaagtgtaaggcattatggaactggttcttatttccctgtttgtgttttggtttgatttggcttttttcttaaatgtcaaaaacgtacccattttcacaaaaatgaggaaaataagaatttgatattttgttagaaaaacttttttttttttttctcaccaccccaagccccatttgtgccctgccacacaaatacacctacagcttttggtcccttgcctcttccacctcaaagaatttcaaggctcttaccttactttatttttgtccatttctcttccctcctcttgcattttaaagtggagggtttgtctctttgagtttgatggcagaatcactgatgggaatccagctttttgctggcatttaaatagtgaaaagagtgtatatgtgaacttgacactccaaactcctgtcatggcacg

SEQ ID NO: 23705 - DNA, 1549 bp, Homo sapiens
gccggcgtgagtcacggcggggctagcctttataacggcccggaggctcgcgggagccgccgcgcccgtccgcccgccgctccgcgctccacccagcgcacccgggccccgcgcccccaactgcctccggcggccgcccagtcccgagggcgccatgaggagcctgtgctgcgccccactcctgctcctcttgctgctgccgccgctgctgctcacgccccgcgctggggacgccgccgtgatcaccggggcttgtgacaaggactcccaatgtggtggaggcatgtgctgtgctgtcagtatctgggtcaagagcataaggatttgcacacctatgggcaaactgggagacagctgccatccactgactcgtaaagttccattttttgggcggaggatgcatcacacttgcccatgtctgccaggcttggcctgtttacggacttcatttaaccgatttatttgtttagcccaaaagtaatcgctctggagtagaaaccaaatgtgaatagccacatcttacctgtaaagtcttacttgtgattgtgccaaacaaaaaatgtgccagaaagaaatgctcttgcttcctcaactttccaagtaacatttttatctttgatttgtaaatgatttttttttttttttatcgaaagagaattttacttttggatagaaatatgaagtgtaaggcattatggaactggttcttatttccctgtttgtgttttggtttgatttggcttttttcttaaatgtcaaaaacgtacccattttcacaaaaatgaggaaaataagaatttgatattttgttagaaaaacttttttttttttttctcaccaccccaagccccatttgtgccctgccacacaaatacacctacagcttttggtcccttgcctcttccacctcaaagaatttcaaggctcttaccttactttatttttgtccatttctcttccctcctcttgcattttaaagtggagggtttgtctctttgagtttgatggcagaatcactgatgggaatccagctttttgctggcatttaaatagtgaaaagagtgtatatgtgaacttgacactccaaactcctgtcatggcacggaagctaggagtgctgctggacccttcctaaacctgtcactcaagaggacttcagctctgctgttgggctggtgtgtggacagaaggaatggaaagccaaattaatttagtccagatttctaggtttgggtttttctaaaaataaaagattacatttacttcttttactttttataaagttttttttccttagtctcctacttagagatattctagaaaatgtcacttgaagaggaagtatttattttaatctggcacaacactaattaccatttttaaagcagtattaagttgtaatttaaaccttgtttgtaactgaaaggtcgattgtaatggattgccgtttgtacctgtatcagtattgctgtgtaaaaattctgtatcagaataataacagtactgtatatcatttgatttattttaatattatatccttatttttgtc

SEQ ID NO: 23706 - DNA, 1155 bp, Homo sapiens
atggcagcccagaatggaaacaccagtttcacacccaactttaatccaccccaagaccatgcctcctccctctcctttaacttcagttatggtgattatgacctccctatggatgaggatgaggacatgaccaagacccggaccttcttcgcagccaagatcgtcattggcattgcactggcaggcatcatgctggtctgcggcatcggtaactttgtctttatcgctgccctcacccgctataagaagttgcgcaacctcaccaatctgctcattgccaacctggccatctccgacttcctggtggccatcatctgctgccccttcgagatggactactacgtggtacggcagctctcctgggagcatggccacgtgctctgtgcctccgtcaactacctgcgcaccgtctccctctacgtctccaccaatgccttgctggccattgccattgacagatatctcgccatcgttcaccccttgaaaccacggatgaattatcaaacggcctccttcctgatcgccttggtctggatggtgtccattctcattgccatcccatcggcttactttgcaacagaaacggtcctctttattgtcaagagccaggagaagatcttctgtggccagatctggcctgtggatcagcagctctactacaagtcctacttcctcttcatctttggtgtcgagttcgtgggccctgtggtcaccatgaccctgtgctatgccaggatctcccgggagctctggttcaaggcagtccctgggttccagacggagcagattcgcaagcggctgcgctgccgcaggaagacggtcctggtgctcatgtgcattctcacggcctatgtgctgtgctgggcacccttctacggtttcaccatcgttcgtgacttcttccccactgtgttcgtgaaggaaaagcactacctcactgccttctacgtggtcgagtgcatcgccatgagcaacagcatgatcaacaccgtgtgcttcgtgacggtcaagaacaacaccatgaagtacttcaagaagatgatgctgctgcactggcgtccctcccagcgggggagcaagtccagtgctgaccttgacctcagaaccaacggggtgcccaccacagaagaggtggactgtatcaggctgaagtga

SEQ ID NO: 23707 - DNA, 1771 bp, Homo sapiens
gctggaaagagctgtggggccggagcgccaactccagctggaacccagagaccctgacacgccggaggagcccgccggggcgaggaaaaaagagggacatcccccacgcagcggctctgcaagtgcaagtccgggtcctcgaggtgaaaaccgagcggcccgcctgcgcccaaccacactgtgactctcgatccggcttccggagcagcagagcgcacagaaaggaggcgccgagacagacatcaccatggcagcccagaatggaaacaccagtttcacacccaactttaatccaccccaagaccatgcctcctccctctcctttaacttcagttatggtgattatgacctccctatggatgaggatgaggacatgaccaagacccggaccttcttcgcagccaagatcgtcattggcattgcactggcaggcatcatgctggtctgcggcatcggtaactttgtctttatcgctgccctcacccgctataagaagttgcgcaacctcaccaatctgctcattgccaacctggccatctccgacttcctggtggccatcatctgctgccccttcgagatggactactacgtggtacggcagctctcctgggagcatggccacgtgctctgtgcctccgtcaactacctgcgcaccgtctccctctacgtctccaccaatgccttgctggccattgccattgacagatatctcgccatcgttcaccccttgaaaccacggatgaattatcaaacggcctccttcctgatcgccttggtctggatggtgtccattctcattgccatcccatcggcttactttgcaacagaaacggtcctctttattgtcaagagccaggagaagatcttctgtggccagatctggcctgtggatcagcagctctactacaagtcctacttcctcttcatctttggtgtcgagttcgtgggccctgtggtcaccatgaccctgtgctatgccaggatctcccgggagctctggttcaaggcagtccctgggttccagacggagcagattcgcaagcggctgcgctgccgcaggaagacggtcctggtgctcatgtgcattctcacggcctatgtgctgtgctgggcacccttctacggtttcaccatcgttcgtgacttcttccccactgtgttcgtgaaggaaaagcactacctcactgccttctacgtggtcgagtgcatcgccatgagcaacagcatgatcaacaccgtgtgcttcgtgacggtcaagaacaacaccatgaagtacttcaagaagatgatgctgctgcactggcgtccctcccagcgggggagcaagtccagtgctgaccttgacctcagaaccaacggggtgcccaccacagaagaggtggactgtatcaggctgaagtgacccactggtgtcacacaattgaaaaccccagtccagtactcagagcatcacccaccatcaaccaagttcataggctgcatgggaaatgacatctgtgttcatgcctcccccgtgccctcaagaagctgaatgctgcaaagtcgtaacatacaatgagactagacatgaaccaaatcagctgacatttactgatatccgctcgacacctactgtgtccacaatcccaacaaggagattagacacaaggagcagcaactgacatggactgaacatgtactgtgtgcaaaccacaccaatgagattagacagggacagcaggagctgacatttactcttcacctactgtaataaaaaacacttgatttgatt

SEQ ID NO: 23708 - DNA, 1354 bp, Homo sapiens
atccttattctatatctcttggtatttagtgtaaaaattttaaaatctttacctagcaatcttgaggaagaaacttgataactgataatacatgagattgttacctaagtgaaatataatcctatatattcaacaaactttagagaaataagataaattttaaagtaaatgacttctgtagttttatagatcctccaaaccaatctagtctcagatctcaccttcatcatttctctcatttccttttggcctaattaatcaaaatccttcctagaatgttcatttctggccagtatgtcttcctgaatatgaataagaaataaaataccatttgatgtttgaaattatgggggtaatctcaatgacggaaatagatgaccaggaaaagggaaacgaatgcctgattcattatattcatgaagatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaatc

SEQ ID NO: 23709 - DNA, 591 bp, Homo sapiens
atgaacatcaaaggatcgccatggaaagggtccctcctgctgctgctggtgtcaaacctgctcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaa

SEQ ID NO: 23710 - DNA, 1679 bp, Homo sapiens
aagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatcttaaaaacatggttctaac

SEQ ID NO: 23711 - DNA, 1297 bp, Homo sapiens
atgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactga

SEQ ID NO: 23712 - DNA, 11485 bp, Homo sapiens
ccgatctggggggaatcagttgtttcttcaggtcttcgcaggattccagctcccccaactacctccgtcgccttctaaaactggcaggctctggacgttttgcatgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatgttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaataatgcctccaattttttcttaaaatagtttagatatgttaagcatggattttccccctaaattctactctaaagcttctataaaatatagtttggaaataaaaatgttcttacacaaggggcaaatgaatttcatgtgaatccctttaggatgttttcctccttcatttcagcatgatagataatttattatacaccttagtctttccttagttaaaaaaaaattccctaaagactaacttgaaaagaaaaccacagcaggatgctaatggaattactgccttactgtacatacaaattctactttaatataaacccataagtttaactgtatttttgaagactatttttctatgacttaggtaaaataaaagactattttctattttcccagtacagctgtttatgtattcagtgggtacagtattttctgctgcaaggttataatgtgtatttacagtacatagtagtatataaagttcccgtttgtggagtaaaatgccataccaacccaaagcccactgtgaaatatgaagtgaatgacaaaattcagttttcaacgcaatatagtatagtttatctgattcttttgatctccaggacactttaaacaactgctaccaccaccaccaacctagggatttaggattctccacagaccagaaattatttctcctttgagtttcaggctcctctgggactcctgttcatcaatgggtgaatcttcctaaagctaccataaaaagggagggcgacgatttctaacagctgtttaaaagagagaggttttgcttttgtgagaaatcttgggccacaaaaaaattttaagcaaagccaggagttagtgtctctctgaagtaaattcaattgcaaaatcttggcagaggcagaaatggctcatatcagaagtgtccaaataaaagttctgggaaactaggtatttgcttcccagagcaatgggaatagctccaaaggtcagagtaaggtaatgagaatctcccggtcaattccagtgccaggcttcctgaaagaagtcaaagcttggatcctcattttaaagggcgcatccatgactcatctagcagcccctctctatttttcccttcacttgatggtaaatccattctatatgtccatttactagctggacatagagaacttgagctcacctctgggagttaaatattccaccccaactatcccatattgatagcaactggactcagaggtccccctcctgtttgaaagtgaacacattgccaatgttttgagaatggcaaaagcaatagatacgaagctccatttttctaatatataaacaatatcatgtgagtaagggaagcgtgtgggaaagttgtccaagctcattcagtcccctaaatcctcgatactttaactgtctgagaaccaactgcataggcatcacctgggcagtgtttgaaaattccatttgcagaatcttaagcatcagaatctgcattttactaagatccccaaatgattcaattgcacactgaagtttgagaagcattgttctagacaaccatttccactaaaggttattttagttcatagtaacaatcctcttttggaaaggacagatcaagtctgtttgacttgcaatgaacaacactgcatgtaagcaggcaaaaaaagaaacatatcagtagtttaagattcacattatgctgaatcttatatgaattcacataaaagaatgacctgcaaaactacgcacaacttctgaaaggccaaggaatataatctaccttgagagacattaaccaaagacagtcaccctcaaagccaatgcagactaaatctttcctaacatagtctattctctaagaatagagaagatatgtatcagtcactcttatagtctgaaaacctaaacataaaagtaatctgcttttgacatataattttgtataatacgtatgaaaaaatgtgacagctaaggacttgaattaaatccctaaaaaacaattagccactcattaggccaagactttaattctatgatcaattagcactgtttatctgaattaagcttttttgtggtctaacaaaaagtttttttgtggtctatcaaggagacagctgttcaaatggaaggatacatgtggggcaggggggcggtgaagagacctagattctggtcctaactgctttgccttggagagattaattcccccctctaagcctcagtttcctctgaagatgttggaccagataacctctaaggtcctttgaaactgactccttgattccatgactcactgaatatttttctgcaaagataatcccaaccaatgccttctatcctaatctaacaaaaaattgctcttcatcatagaaatacaaagtaatcttcagtgatgtgctctttatactttgctttttaaaccgtccattccagttggtcttaatatattgcacaagtattttataagtgaaatgtgtacagaatcatattctaagattatgtgcaaatatatgtgtagaaagaggcatttaaaaaaagaggcaggagattgagaagagacatattgaatgaggcactaatctttagaaaaatgatcttttactgaatcaagccatgctcattccttgctgaatccaacagccccaaatctcttttcttatatttggctgttaatttttttccttgcaccatcctagattgttaacaaccattgcacagttggctcatgtatccttacactctgagttataataagttgtatttttataaacaaatacctaaatattcaagttttaaggcgcatggaaactgaatctaggcaacgggtgatttgtgtagcttacaacctgaacagcaagatgttccaattcattctaacagatgtgtataagcacaagttatatcagctgtgtcagatatttaacagatcctacatttattagctatataacagactctacattttcctaagtgcctaagaccaatcctggtagtcacttaagtacaaaagactcactttaactggcttggtctgaaggggtcaatcctttactgcctgtacaagatctgggcagttttgctctgtgtcttgtgatgacccagctgaatgtgaaaagcctatgagttattgagcaaccagaggtccctgcattccaagttgcagtttagctctggggaaactctggctttctctttcctcaagtgtccaccactgcccatcatttgcagaaagacttggccctgcctttagcaacttccctatctccttagagtagacaagaaagaaacagatttgtgcacattttacaaagtgccttcctctatttttttttaaagttttcattttgcaaggaaaaatgtattgattagaaagtaacatttgccttatagggattatatatatatatagatatagatatagatatgtatgaatggagagatgagaagaagccagaaagggcacaacaaaatggtctaagggccaaccagcaatgttcagtgaatgtttacgtattgtttaattgaatcaacacagagctgttgtgaatagtgtgacttactttgcctgataagaaattgaggctggctgtgatttggggataaacctgccaccctgtgatttgagactctccataccaaaacttattgatacatttttgaatgtcattggcttacatgcctaaacctgaagagaacaatgcatgcacattggaactttgtacacaaacagaaaaatataaatgactttgaattaccatcccaagcattgctaacgtagatgtgccattgacgaaagtctcatgtgttcttgagtgaacaaatttccttttcttcctttttggctcaagcacaataatgctgtcactgagacagtgactgagcactcaatgtccaagactaaatcacatcaccacgactaagtaggcactatgtcctgggatgagtcttttaaactctggccatcaggttccttacttgttaaataagtaggttggcctaaaaggtttctaagacctctcatgatctaggtaaaatccagggtttcaggtcagtgtccctggtgcagtgcaagaaagccttgctgacacacccttggcctgaagcagtgagcacatgagattgtgtgacaacgcttcagagaaaaacagagatctgttcctccaactcagattgatttaacatccttgcttctccttttccttcctggctttacatatttgtagggtttttactccttctccagagcctactattttcctaagagttagtagcaaccataggatccacaagaaatgaaattattcatcaacaatgactttggcactgcaaaagactgagtcaaaggttaaatcagtcacacagatatccaaggccaagttgaagatcacaagtatatcccatttagagatttgcatacttagagattaagcccatgttcattaattatttagttaattcaaaagccattaataaatccatgcccagcctacgcaacatagtaagacccagtctctacaaaaattttaaaaattagccagccatggtgacacgtacctgtagtcctagacacttgggaaggtgaagccagaggattgcttgagcccaggaggtcgaggctgcagtgaaccgtgattgtgtcactgcactccagcctgggtgagagagcaagaccttgtctcaataaataaacccaagttacttcgatgactagatactggaggtctgaaggagaagctttaaaaatacagattgattgcttcagagaaatcctatttataattatgatctgaacttattctatgattagcaaatatatcatctgaaaataaaacaggagttctctccccagacttttgtttttcaggatggtgagttttggtctgggaccctcatggcacccattttgataaaaggaaaaagatagtaaaacaggaaataggaagtttccagagatttgggcatctcaggattccatgaaatgctgagactaacccactaaatccaaattttattggctatggtaaatctaaatctgttcagtgttctgaacagattttatgagtttatgtctaagagtttatgtctaagagaggtacataattcacaaacactatcatgctggcagctgttttgtccacatcaattcccttgatttaatgctctgatttcaatttagaaagtactgagacatgtaaagtctcaaaataggaaaaacctatcctgtttataaggtgtggtcaataaatagaccacagataatcttagtctattaattaactctcagatcatcttagactattaattaacattctgcttgctgctgattaaaaagaaaaaaaccctaaaaccttcagcaactgaagtagtaatataaaaaataacctttaatagttatggtcaaattacgcttcacttggataaacctcaaaatgtagtctgagtttttttgtgcacacttcacaaatcctgggggaaaaatcttttttccacgttatctgaaaaactatatggcgaagataccgctgaaaaataatttgttttatgaaattcctgaaaagctaattttgaattttttaaagtaactacctcccttttgtgtcctaatgtccttccttcaaagctgcttatagtttagaaatgaaagatgtcatgtctcatgctttgactggttttcggtggcatatttgatgtatttgccaagtggcattactgactttacagtaactgttacattattttgtactatattgctttatgtggttcaaaaatagtatatgccatattgaaatatgtaatcctcatgttgtgaaactcatcatgtaatacaatgaaaatcattacttaataacttacaatttatccatatgtagtttcaatatgattgtgtctatgactgtaaaacaaactgaaaaaatatgtaatgtatttctgttgaaagcgtgaatgtactaattttttcctaatcttgtctagaagaaagattctatgtcattcattgtacagctgctctggggtgttacacatttaaagtacaatccaacagttgtttgaaagtcagcctctcggctttgtttcatgtgactgctgacacttctcaagtgttctttgcataatgaggctggattttgtgcttcatcgttcattttaaacaattgaaaagtctcatgtggaaaccaaagcaatctagaaccagcctgttgggtgactgtgtcttctgtaaagccatattgaagtgaagttatacataatagcataaggttccacattttcaaagctaccactacctctgcttttcctctttccctagaaaatgccaagcaaaattccccaacactaagtgagaaattagaagtaattgttttataattaagttgctgggttttttttttaacaccttctaattcatcactttgtagggttatgcaagagtttctgaataaccattcttacatgtttatattttataaaaaccggctgcaagaaagattcagaaagaatacttagtaagtcatcatatgaaaaaccaacaaaaccatagagtgcagattttttcctaactataagtcacctcatagttgtccaaagccatgataatgatatctcttacaaattgacttctgtaacccccctagaaataacccttttccttatttgattttagtcatcaaacatagtatgatatgggaaaagtcagccatttaccagaaattatcttattttgattttaaaaactcatttctatatgtagttattgtaatgtctatttttttagacttaaagatttatagaagactatagttatctgatttgttattttgcatttttcattctgtaaatctttgcttatggcacattgtgctctctgttttccatggttttattcatttatctcctcctattttgaggggacaacatgggtagttaaatctttgtcaatagtattggagataacactaactgctattatcataacatcttcatttttactgcatgccaaaaccaatgcctgccaaacaaaatcttagacatcccaatataatatgttagttatatttctattcacatcattattgaaaatacccagctcagtgcctggcttaataaatgtttaattcccttacctactcttgctctatttttttatttgaaatggagatgagcaaaataacacattcatggctgaagcaattttttggacatttcttgttaccaaaagatctataatcaggacattgtttatgtaagttggacaaaaaaaattcttcccctttatgtccacccttcctatgattgcaagacaaaatttccctcctttacctcatccctataacatgggaggctgagaaaaatgaggggagatggaaccagatacaaggagatccaataagagaagcttatttaaatattgtgaaataaaggaagaaccaaagcatttttttaagtggggaatccttttgaacagttattatttatccatattattaacaacatcttttctgacaaaatccatcagatgaagtgtaaatggataatcttttaatggatctaaacctagaaagtttcacttactgttcatgtccgtgttccagaattgtgaaatggtgtgtggttttgctttccaagttcttctctgcctcctcttaattctctaattccatgtcttacagaagaatgagaaatttctttcttacttgagtatcatgctctaaaaaacttggcttcagtcacagaaacgctggctctcctgtgcttatattgaagccaactgcctttaattcttgggccctcttatatttttaaggtgcaaaatttgaagtctcagtcaccagacacaggttctatacaattaatgatgagctggagaagtaatatgtagctaatttttcaaaagcattgaatatactttccggaaagaaaacagaaattaaatattgccacatcttgccagaatcccatctgacaccttaactttgtcaggtttcctacaacttgctaatcaagttttatacattctaaatctccccagtttctttggggctggaagatgcaacttccatttaatagaaactttgaaatcttggggtaagggagcagtggggggactagggagaaggataagaaatagaattattgaaaagcccccaccagggaccttcctggccagaatatgcagagtaattcctgctggcttcacctttgaaagtccctcgaaactatgcagatgaaactgagtctgtttttgatattgtcagatgtattctaccttggaagtcccaacacctaaactggaattcttgtatttacatctcctccactgtcccccacaccacccctcaattcctgctgcccctgctaatgttaagcatttttctcttgttatcatcaggttcacattaaaaacagatacttacaaactgacttgaagcacagatacttttacgaatgtgataaaatattttcttaagaaaaggaaagaggatgtgggtcaaataaaacaccgcatggatgttgattggtgaatactggtgtaagaaaagggagctcaggaatttttattactgtatttgtaaatgagtttgaaggaatttgtaaatgccactggtacatttttaaggtgacacatttgctccttataaagttattaaaaattacagggtaagcttaaatgacgtttgccagtagttttactttatataatcaatattgatattgttgctgaactatgtaactttatgatgcatttttcagtcccttttcagagcaaatgcttttgcaatggtagtaatgtttagtttaaattgacttaataaattattacctgagcaatggtt

SEQ ID NO: 23713 - DNA, 1339 bp, Homo sapiens
aagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatctta

SEQ ID NO: 23714 - DNA, 11680 bp, Homo sapiens
atgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaataatgcctccaattttttcttaaaatagtttagatatgttaagcatggattttccccctaaattctactctaaagcttctataaaatatagtttggaaataaaaatgttcttacacaaggggcaaatgaatttcatgtgaatccctttaggatgttttcctccttcatttcagcatgatagataatttattatacaccttagtctttccttagttaaaaaaaaattccctaaagactaacttgaaaagaaaaccacagcaggatgctaatggaattactgccttactgtacatacaaattctactttaatataaacccataagtttaactgtatttttgaagactatttttctatgacttaggtaaaataaaagactattttctattttcccagtacagctgtttatgtattcagtgggtacagtattttctgctgcaaggttataatgtgtatttacagtacatagtagtatataaagttcccgtttgtggagtaaaatgccataccaacccaaagcccactgtgaaatatgaagtgaatgacaaaattcagttttcaacgcaatatagtatagtttatctgattcttttgatctccaggacactttaaacaactgctaccaccaccaccaacctagggatttaggattctccacagaccagaaattatttctcctttgagtttcaggctcctctgggactcctgttcatcaatgggtgaatcttcctaaagctaccataaaaagggagggcgacgatttctaacagctgtttaaaagagagaggttttgcttttgtgagaaatcttgggccacaaaaaaattttaagcaaagccaggagttagtgtctctctgaagtaaattcaattgcaaaatcttggcagaggcagaaatggctcatatcagaagtgtccaaataaaagttctgggaaactaggtatttgcttcccagagcaatgggaatagctccaaaggtcagagtaaggtaatgagaatctcccggtcaattccagtgccaggcttcctgaaagaagtcaaagcttggatcctcattttaaagggcgcatccatgactcatctagcagcccctctctatttttcccttcacttgatggtaaatccattctatatgtccatttactagctggacatagagaacttgagctcacctctgggagttaaatattccaccccaactatcccatattgatagcaactggactcagaggtccccctcctgtttgaaagtgaacacattgccaatgttttgagaatggcaaaagcaatagatacgaagctccatttttctaatatataaacaatatcatgtgagtaagggaagcgtgtgggaaagttgtccaagctcattcagtcccctaaatcctcgatactttaactgtctgagaaccaactgcataggcatcacctgggcagtgtttgaaaattccatttgcagaatcttaagcatcagaatctgcattttactaagatccccaaatgattcaattgcacactgaagtttgagaagcattgttctagacaaccatttccactaaaggttattttagttcatagtaacaatcctcttttggaaaggacagatcaagtctgtttgacttgcaatgaacaacactgcatgtaagcaggcaaaaaaagaaacatatcagtagtttaagattcacattatgctgaatcttatatgaattcacataaaagaatgacctgcaaaactacgcacaacttctgaaaggccaaggaatataatctaccttgagagacattaaccaaagacagtcaccctcaaagccaatgcagactaaatctttcctaacatagtctattctctaagaatagagaagatatgtatcagtcactcttatagtctgaaaacctaaacataaaagtaatctgcttttgacatataattttgtataatacgtatgaaaaaatgtgacagctaaggacttgaattaaatccctaaaaaacaattagccactcattaggccaagactttaattctatgatcaattagcactgtttatctgaattaagcttttttgtggtctaacaaaaagtttttttgtggtctatcaaggagacagctgttcaaatggaaggatacatgtggggcaggggggcggtgaagagacctagattctggtcctaactgctttgccttggagagattaattcccccctctaagcctcagtttcctctgaagatgttggaccagataacctctaaggtcctttgaaactgactccttgattccatgactcactgaatatttttctgcaaagataatcccaaccaatgccttctatcctaatctaacaaaaaattgctcttcatcatagaaatacaaagtaatcttcagtgatgtgctctttatactttgctttttaaaccgtccattccagttggtcttaatatattgcacaagtattttataagtgaaatgtgtacagaatcatattctaagattatgtgcaaatatatgtgtagaaagaggcatttaaaaaaagaggcaggagattgagaagagacatattgaatgaggcactaatctttagaaaaatgatcttttactgaatcaagccatgctcattccttgctgaatccaacagccccaaatctcttttcttatatttggctgttaatttttttccttgcaccatcctagattgttaacaaccattgcacagttggctcatgtatccttacactctgagttataataagttgtatttttataaacaaatacctaaatattcaagttttaaggcgcatggaaactgaatctaggcaacgggtgatttgtgtagcttacaacctgaacagcaagatgttccaattcattctaacagatgtgtataagcacaagttatatcagctgtgtcagatatttaacagatcctacatttattagctatataacagactctacattttcctaagtgcctaagaccaatcctggtagtcacttaagtacaaaagactcactttaactggcttggtctgaaggggtcaatcctttactgcctgtacaagatctgggcagttttgctctgtgtcttgtgatgacccagctgaatgtgaaaagcctatgagttattgagcaaccagaggtccctgcattccaagttgcagtttagctctggggaaactctggctttctctttcctcaagtgtccaccactgcccatcatttgcagaaagacttggccctgcctttagcaacttccctatctccttagagtagacaagaaagaaacagatttgtgcacattttacaaagtgccttcctctatttttttttaaagttttcattttgcaaggaaaaatgtattgattagaaagtaacatttgccttatagggattatatatatatatagatatagatatagatatgtatgaatggagagatgagaagaagccagaaagggcacaacaaaatggtctaagggccaaccagcaatgttcagtgaatgtttacgtattgtttaattgaatcaacacagagctgttgtgaatagtgtgacttactttgcctgataagaaattgaggctggctgtgatttggggataaacctgccaccctgtgatttgagactctccataccaaaacttattgatacatttttgaatgtcattggcttacatgcctaaacctgaagagaacaatgcatgcacattggaactttgtacacaaacagaaaaatataaatgactttgaattaccatcccaagcattgctaacgtagatgtgccattgacgaaagtctcatgtgttcttgagtgaacaaatttccttttcttcctttttggctcaagcacaataatgctgtcactgagacagtgactgagcactcaatgtccaagactaaatcacatcaccacgactaagtaggcactatgtcctgggatgagtcttttaaactctggccatcaggttccttacttgttaaataagtaggttggcctaaaaggtttctaagacctctcatgatctaggtaaaatccagggtttcaggtcagtgtccctggtgcagtgcaagaaagccttgctgacacacccttggcctgaagcagtgagcacatgagattgtgtgacaacgcttcagagaaaaacagagatctgttcctccaactcagattgatttaacatccttgcttctccttttccttcctggctttacatatttgtagggtttttactccttctccagagcctactattttcctaagagttagtagcaaccataggatccacaagaaatgaaattattcatcaacaatgactttggcactgcaaaagactgagtcaaaggttaaatcagtcacacagatatccaaggccaagttgaagatcacaagtatatcccatttagagatttgcatacttagagattaagcccatgttcattaattatttagttaattcaaaagccattaataaatccatgcccagcctacgcaacatagtaagacccagtctctacaaaaattttaaaaattagccagccatggtgacacgtacctgtagtcctagacacttgggaaggtgaagccagaggattgcttgagcccaggaggtcgaggctgcagtgaaccgtgattgtgtcactgcactccagcctgggtgagagagcaagaccttgtctcaataaataaacccaagttacttcgatgactagatactggaggtctgaaggagaagctttaaaaatacagattgattgcttcagagaaatcctatttataattatgatctgaacttattctatgattagcaaatatatcatctgaaaataaaacaggagttctctccccagacttttgtttttcaggatggtgagttttggtctgggaccctcatggcacccattttgataaaaggaaaaagatagtaaaacaggaaataggaagtttccagagatttgggcatctcaggattccatgaaatgctgagactaacccactaaatccaaattttattggctatggtaaatctaaatctgttcagtgttctgaacagattttatgagtttatgtctaagagtttatgtctaagagaggtacataattcacaaacactatcatgctggcagctgttttgtccacatcaattcccttgatttaatgctctgatttcaatttagaaagtactgagacatgtaaagtctcaaaataggaaaaacctatcctgtttataaggtgtggtcaataaatagaccacagataatcttagtctattaattaactctcagatcatcttagactattaattaacattctgcttgctgctgattaaaaagaaaaaaaccctaaaaccttcagcaactgaagtagtaatataaaaaataacctttaatagttatggtcaaattacgcttcacttggataaacctcaaaatgtagtctgagtttttttgtgcacacttcacaaatcctgggggaaaaatcttttttccacgttatctgaaaaactatatggcgaagataccgctgaaaaataatttgttttatgaaattcctgaaaagctaattttgaattttttaaagtaactacctcccttttgtgtcctaatgtccttccttcaaagctgcttatagtttagaaatgaaagatgtcatgtctcatgctttgactggttttcggtggcatatttgatgtatttgccaagtggcattactgactttacagtaactgttacattattttgtactatattgctttatgtggttcaaaaatagtatatgccatattgaaatatgtaatcctcatgttgtgaaactcatcatgtaatacaatgaaaatcattacttaataacttacaatttatccatatgtagtttcaatatgattgtgtctatgactgtaaaacaaactgaaaaaatatgtaatgtatttctgttgaaagcgtgaatgtactaattttttcctaatcttgtctagaagaaagattctatgtcattcattgtacagctgctctggggtgttacacatttaaagtacaatccaacagttgtttgaaagtcagcctctcggctttgtttcatgtgactgctgacacttctcaagtgttctttgcataatgaggctggattttgtgcttcatcgttcattttaaacaattgaaaagtctcatgtggaaaccaaagcaatctagaaccagcctgttgggtgactgtgtcttctgtaaagccatattgaagtgaagttatacataatagcataaggttccacattttcaaagctaccactacctctgcttttcctctttccctagaaaatgccaagcaaaattccccaacactaagtgagaaattagaagtaattgttttataattaagttgctgggttttttttttaacaccttctaattcatcactttgtagggttatgcaagagtttctgaataaccattcttacatgtttatattttataaaaaccggctgcaagaaagattcagaaagaatacttagtaagtcatcatatgaaaaaccaacaaaaccatagagtgcagattttttcctaactataagtcacctcatagttgtccaaagccatgataatgatatctcttacaaattgacttctgtaacccccctagaaataacccttttccttatttgattttagtcatcaaacatagtatgatatgggaaaagtcagccatttaccagaaattatcttattttgattttaaaaactcatttctatatgtagttattgtaatgtctatttttttagacttaaagatttatagaagactatagttatctgatttgttattttgcatttttcattctgtaaatctttgcttatggcacattgtgctctctgttttccatggttttattcatttatctcctcctattttgaggggacaacatgggtagttaaatctttgtcaatagtattggagataacactaactgctattatcataacatcttcatttttactgcatgccaaaaccaatgcctgccaaacaaaatcttagacatcccaatataatatgttagttatatttctattcacatcattattgaaaatacccagctcagtgcctggcttaataaatgtttaattcccttacctactcttgctctatttttttatttgaaatggagatgagcaaaataacacattcatggctgaagcaattttttggacatttcttgttaccaaaagatctataatcaggacattgtttatgtaagttggacaaaaaaaattcttcccctttatgtccacccttcctatgattgcaagacaaaatttccctcctttacctcatccctataacatgggaggctgagaaaaatgaggggagatggaaccagatacaaggagatccaataagagaagcttatttaaatattgtgaaataaaggaagaaccaaagcatttttttaagtggggaatccttttgaacagttattatttatccatattattaacaacatcttttctgacaaaatccatcagatgaagtgtaaatggataatcttttaatggatctaaacctagaaagtttcacttactgttcatgtccgtgttccagaattgtgaaatggtgtgtggttttgctttccaagttcttctctgcctcctcttaattctctaattccatgtcttacagaagaatgagaaatttctttcttacttgagtatcatgctctaaaaaacttggcttcagtcacagaaacgctggctctcctgtgcttatattgaagccaactgcctttaattcttgggccctcttatatttttaaggtgcaaaatttgaagtctcagtcaccagacacaggttctatacaattaatgatgagctggagaagtaatatgtagctaatttttcaaaagcattgaatatactttccggaaagaaaacagaaattaaatattgccacatcttgccagaatcccatctgacaccttaactttgtcaggtttcctacaacttgctaatcaagttttatacattctaaatctccccagtttctttggggctggaagatgcaacttccatttaatagaaactttgaaatcttggggtaagggagcagtggggggactagggagaaggataagaaatagaattattgaaaagcccccaccagggaccttcctggccagaatatgcagagtaattcctgctggcttcacctttgaaagtccctcgaaactatgcagatgaaactgagtctgtttttgatattgtcagatgtattctaccttggaagtcccaacacctaaactggaattcttgtatttacatctcctccactgtcccccacaccacccctcaattcctgctgcccctgctaatgttaagcatttttctcttgttatcatcaggttcacattaaaaacagatacttacaaactgacttgaagcacagatacttttacgaatgtgataaaatattttcttaagaaaaggaaagaggatgtgggtcaaataaaacaccgcatggatgttgattggtgaatactggtgtaagaaaagggagctcaggaatttttattactgtatttgtaaatgagtttgaaggaatttgtaaatgccactggtacatttttaaggtgacacatttgctccttataaagttattaaaaattacagggtaagcttaaatgacgtttgccagtagttttactttatataatcaatattgatattgttgctgaactatgtaactttatgatgcatttttcagtcccttttcagagcaaatgcttttgcaatggtagtaatgtttagtttaaattgacttaataaattattacctgagcaa

SEQ ID NO: 23715 - DNA, 1206 bp, Homo sapiens
aagagaaggcagccaacatgaaggaaaatgtggcatctgcaaccgttttcactctgctactttttctcaacacctgccttctgaatgagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatctta

SEQ ID NO: 23716 - DNA, 568 bp, Homo sapiens
agcaaaggtgaggcagctgtgtctccctctggctgccttttctcccctcctctctcaccagaagccaacgcgtacacgctgagtggagaggccgcgaggacaagacagtgggacatgcgtgtgctggggaagtcgagaagcaggacaggaggcagctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggt

SEQ ID NO: 23717 - DNA, 583 bp, Homo sapiens
attttaccgaccgttcgcgaaacagctttccacacaatggagcttcatgtcctcgtgcaggaagtactcatcgactgatgtggcagactttgctccctggcaaaagtcttacggataccaagtcccatgcctgccagcttgcacctgttaagtcatgtgatacttaggaaatgtacacatcaccccagtgcagaggcctttatccacttcccttcattttgcctggattgttgctgtgagtgagaaataaatgacatgaaatgatcatgtatatcactgtcttcagaggatgctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactg

SEQ ID NO: 23718 - DNA, 579 bp, Homo sapiens
agtccttggagtgaactgggagacaaggaggctgctttggcatggagctgagaacatctctagatcgcactggaaggcagagagaggccagacagggaactctgaagagctgccacagcctgtgccagggtgacatcaggctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagca

SEQ ID NO: 23719 - DNA, 1566 bp, Homo sapiens
atgaaggaaaatgtggcatctgcaaccgttttcactctgctactttttctcaacacctgccttctgaatgttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactga

SEQ ID NO: 23720 - DNA, 1525 bp, Homo sapiens
aagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggaggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatcttaaaaacatggttctaac

SEQ ID NO: 23721 - DNA, 588 bp, Homo sapiens
cttattcctcctgctttgctgaaaccacagctgccttgaatcgagccattttgattctgccgcaaatgagctgtaaaccaaatcaagccacatcaaacaaatccaaccaccatcaaaagcaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacg

SEQ ID NO: 23722 - DNA, 581 bp, Homo sapiens
acagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaagttgtaaaaggatgactgcgtagagccacagcattctccttgtcagtgtaggaaatgcagaggaggatttacctccggcacttgcctctaagacacctaataaagatgaggaaggctccagcctgaagcgtgggtgaggtgtccagctgcccaaaggcgacagctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatcttta

SEQ ID NO: 23723 - DNA, 1086 bp, Homo sapiens
aagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggca

SEQ ID NO: 23724 - DNA, 2166 bp, Homo sapiens
gcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgccgctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaa

SEQ ID NO: 23725 - DNA, 1692 bp, Homo sapiens
ttggacggagccgagctgaggctcggcttcctgctgatggtcagggttttggcaactccccggtgtgagaggggtagggagtgctcccggcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgccgctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgt

SEQ ID NO: 23726 - DNA, 585 bp, Homo sapiens
accacttctctgggacacattgccttctgttttctccagcatgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagtcactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgcttctcca

SEQ ID NO: 23727 - DNA, 2577 bp, Homo sapiens
gtttttccgggagagaccacgcttcccctcaagctccccaacggctccgccttcccgccggagcctgacccttcccagagtgcccggcgattccggcgtgcgaggcccttggagggcaaggccccagggcctggcttaggagcgcgagaggcaggctgggaattgtagttcgaaggccctcgagagcggctagagtctggcggccgagaggactagttgtcccagcgtgccctgcgcctcagcccgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgtttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaaca

SEQ ID NO: 23728 - DNA, 1215 bp, Homo sapiens
gcgtgccctgcgcctcagcccgcgcgctcgcagcttctcgctctcgcctgcctgcccgctcccttgcttgctcgcgctttcgctcgccctctcctcgaggatcgaggggactctgaccacagccctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaagaagaaaaaa

SEQ ID NO: 23729 - DNA, 2961 bp, Homo sapiens
aatatttatatttcctctgtcttttaaaactgaacaccgaggtgggttttgtggtgggtggtgaacggacaggtttgggcctcgatcccccacccgaccctagcacccacaggtgggggtgccccctctgctgatgcgcctcctccctcagcaccatggacctgctggactggagcagcctcatcgacagcaggaccaagctgtccaagcacttggtagtccccaacgcacaggtaacacctccgctcctcagtgaggcccagctcagcagggcgctgcgctaagaagggaattcagcctgccacgtgtgtctcttgttgcctaccctgggaacttaacatgaccaaaatcactgcacactatggccccacagaccccctgtggtccagggggaagaagacaagcccactagtgtccacagagtgcttggcgggacagagacccacgcggagccttaagacaccacaaggagagggggtctgggggccttccccaagtcatctgtcttgtgcatcaggtcaccccaaacttcagaggcctgaaacggcagcagccactctgcttctgcctcatggttctggggttgacagggctcagctgggcagtcctcccctggggtctcctgggtagctgtactcacagagtggtggcgctgggacctgggggaggcacccattcacatgtctgggagttggtgctggctgtggcttgggctttttcccaacatggcagctgggctctaagggccagtgtcacctgagacgtgagagccaggcagaagctgggtgaccttttcctgcctcgcctcagaagtcacacggtgtcttttctggcaagttctgtttgttagaagcatgtcaccaggccagcctgtatacagcggggagaggaatgagactcatctgcctgtgggaggggggcccaggacctggcagactgcttgaaaccacagcttaaactgggattcaaagaaagaacagaagcaccttcagaaaacatcctgcagaggcagctttccatgacacatctagccccagtccactaagggcccagcctcaaacttagagcccccgacccagagcctcggggcgcagtgcgtacagtgtggctgtgcaccaaggccaccagctgttggagactttagcatggtgtagcaagggatagagtggtactgtttgtgcccagtgaggcaaggctgctggggccagcaaaggggtgagcgggaggccctgcgggatgggtccccacggcctctgagcaccagcaacttgaaggcctcatcctggtggttgccctggtccctggctacgtgtcagcacgtgctgcacaactgccctgtctgcctgtagccaggggtcttcctcctgggccctctgcctgctccgggtggagcccttctgtttgacgattgggtgatcagtgttcacttgttcaatgtcacatgggagttgcagggggctctcccacaacggtggggcctctgtgggaactggggagtacacacttcggagtgcaggcctggactgagcctggggcccactgacatgggcactgagctccctcgtggtacccctaggccccgcatagggcagtgcactggctgcgttggaggttcaggggcactgtgctgcttgtccaggtggccctccctcccagccctgcacagacgggtgagagggttcctgtgggctgggaatactgagagaggtttagcctgggcctcagggtggcactttcccgcccttgctgtggcctgaccgcgtgttgcacccccagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 23730 - DNA, 2462 bp, Homo sapiens
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatatagggtgaggcctctgggaccgagcggggcggggcggggcggggcggggcggggcgggaccaacagcgcacacttaagcggcccgggcgggtaccgccgtcccgccatggctctgaggcgcgccctgcccgcgctgcgcccctgcattccccgcttcgtcccgctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 23731 - DNA, 1985 bp, Homo sapiens
gctgaagtgccagggtgcttgtgaagtctaagcccttgtctggcatttgtcaggaatataggctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 23732 - DNA, 1677 bp, Homo sapiens
tagagatggggtctcactatgtcgcccagggtagtctcaaactcctcggtcttggcctcccaaagtgttgggattacaaacgtgagaaccgtattttcaaatgtattcaataacactacagcgtttccaattttaagaggaagcaattgccacaaaatcactgcccctggtctgggcaaggggcagttggtgaacttgctgcctccagagaaccttccctggtgtggaggcagccagggacccaggatgctccggacctgttacgtgctctgttcccaagctggtcccccctccaggggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcaggcgcatttctccgagcatccgtctatgggcagtttgtggctggtgagacagcagaggaggtgaagggctgcgtgcagcagctgcggaccctcagcctccgaccactgctggcagtgcccactgaggaggagccggactctgctgccaagagtggtgaggcgtggtatgaggggaacctcggtgctatgctgcggtgtgtggacctgtcacggggcctcctggagccccccagcctggctgaggccagcctcatgcagctgaaggtgacggcgctgaccagtactcggctctgtaaggagctagcctcgtgggtcagaaggccaggagcctccttggagctgagccccgagaggctggctgaagctatggactctgggcagaacctccaggtctcctgcctcaatgctgagcagaaccagcacctccgggcctccctcagccgcctgcatcgggtggcacagtatgcccgggcccagcacgtgcggctcctggtggatgcggagtacacctcactgaaccctgcgctctcgctgctggtggctgccctggctgtgcgctggaacagcccgggtgaaggcgggccctgggtgtggaacacctaccaggcctgtctaaaggacacattcgagcggctggggagggatgcagaggctgcgcacagggccggcctggccttcggagtgaagctggtacgaggtgcatatctggacaaggagagagcggtggcccagctccatgggatggaagaccccactcagcctgactatgaggccaccagtcagagttacagccgctgcctggaactgatgctgacgcacgtggcccgccatggccccatgtgccacctcatggtggcttcccacaatgaggaatctgttcgccaggcaaccaagcgcatgtgggagctgggcattcctctggatgggactgtctgtttcggacaacttctgggcatgtgtgaccacgtctctctagcactggggcaggccggctatgtagtgtataagtccattccctatggctccttggaggaggtaatcccctacctgatccggagggcccaggagaaccggagcgtgcttcagggtgcccgcagggaacaggagctgctcagccaagaactgtggcggcggctgctgccaggatgccgaaggataccccactagcacccctgagggggtcatgtggtcaataaaagtccttaggtgctgcct

SEQ ID NO: 23733 - DNA, 932 bp, Homo sapiens
gatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagaacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccatccaggcgtcaatggacctcctctgtga

SEQ ID NO: 23734 - DNA, 1797 bp, Homo sapiens
agaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcgctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccatccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgcctttgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaa

SEQ ID NO: 23735 - DNA, 2254 bp, Homo sapiens
aacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccatccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgcctttgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaa

SEQ ID NO: 23736 - DNA, 2254 bp, Homo sapiens
aacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaa

SEQ ID NO: 23737 - DNA, 1797 bp, Homo sapiens
agaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcgctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaa

SEQ ID NO: 23738 - DNA, 1797 bp, Homo sapiens; identical to SEQ ID NO: 23737

SEQ ID NO: 23739 - DNA, 1797 bp, Homo sapiens; identical to SEQ ID NO: 23737

SEQ ID NO: 23740 - DNA, 2254 bp, Homo sapiens; identical to SEQ ID NO: 23735

SEQ ID NO: 23741 - DNA, 2254 bp, Homo sapiens; identical to SEQ ID NO: 23736

SEQ ID NO: 23742 - DNA, 1797 bp, Homo sapiens; identical to SEQ ID NO: 23734

SEQ ID NO: 23743 - DNA, 1797 bp, Homo sapiens; identical to SEQ ID NO: 23737

SEQ ID NO: 23744 - DNA, 1797 bp, Homo sapiens; identical to SEQ ID NO: 23734

SEQ ID NO: 23745 - DNA, 2254 bp, Homo sapiens; identical to SEQ ID NO: 23735

SEQ ID NO: 23746 - DNA, 2254 bp, Homo sapiens; identical to SEQ ID NO: 23736

SEQ ID NO: 23747 - DNA, 2254 bp, Homo sapiens; identical to SEQ ID NO: 23736

SEQ ID NO: 23748 - DNA, 932 bp, Homo sapiens
gatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagaacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtga

SEQ ID NO: 23749 - DNA, 932 bp, Homo sapiens; identical to SEQ ID NO: 23748

SEQ ID NO: 23750 - DNA, 932 bp, Homo sapiens; identical to SEQ ID NO: 23748

SEQ ID NO: 23751 - DNA, 932 bp, Homo sapiens; identical to SEQ ID NO: 23733

SEQ ID NO: 23752 - DNA, 932 bp, Homo sapiens; identical to SEQ ID NO: 23748

SEQ ID NO: 23753 - DNA, 932 bp, Homo sapiens; identical to SEQ ID NO: 23733

SEQ ID NO: 23754 - DNA, 563 bp, Homo sapiens
aacgcagagttgggagcaactccagagcctccttcaagatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaa

SEQ ID NO: 23755 - DNA, 508 bp, Homo sapiens
cagagttgggagcaactccagagcctccttcaagatgctgctggtcctgctctcagtggtccttctggctctgagctcagctcagagcacagataatgatgtgaactatgaagactttactttcaccataccagatgtagaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgc

SEQ ID NO: 23756 - DNA, 326 bp, Homo sapiens
agagttgggagcaactccagagcctccttcaagatgctgctggtcctgctctcagtggtccttctggctctgagctcagctcagagcacagataatgatgtgaactatgaagactttactttcaccataccagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaa

SEQ ID NO: 23757 - DNA, 5977 bp, Homo sapiens
tagttgtgaattctggtcctgccactgtcactgttgatttgcttaaccttgtctgagcccgtctctctgggctgtatctcctcatctatctctgaggtcctttccaattggaagttgcaaagattcattgaggggagcaaggaaggaggagcctcagcctttaggagctttcctttttaaaagaaaaaggtcaacccttggttcttatagatgctcagaacatgttcttgggggaaaacgctgaaaggtttgctttgggccctactgggcctggggaggtctctggagaagagcttggggcagaatgagaagcagcggaagccatgggtggctgcatggaggacgacgcaccccacaagagaagtgagaccctgcagctgagggagcatcatggcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacgatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacaccctcccccgggtcatggtgtaccggggtactgtgcatagccaaggggagccttctgggcaccgagaggcagcgaacagcccccaggtggtgctggggcccagtcgggggggcaggaccacagtccggctagagagcaccctctacctccctgagctctctctctccagactgtccagcaccacccctcccccctcctacgaggaggtgactgcgccccaagagagcagcagtgaggaggccagcgtgtcttacagtgacccacccccaaagtacgaggagatagtggccgccaaccctggcgctgacaagtagtgggacgtttgtgccctgtcctggatgaacgcctctttccgaggtctcctattttctttttaactttttaaagactgtgccaccacaaaacagccttagcctccttgttgccaaataattccctaactgtggagttttaggaagtcagttgtcagagacaggtggggagggtgggggtagggaccacgcatgagtcgaagcccccgggaagagccaaaggccaaagtgcccaactctttgggatgacccccaagcctccaacatcctgtctttccatcaggaactggcttctcttatgccaaaggaataaccccattgagttgattgtggccagaatgtccacaggcctggcctgggggctgtgggactggctggaggcctgcctgtgtctagagctctgggcctcaggggtaagggaaggaagccagcctttcagcaccccttaccctccacagttctgtgatttctgtccttgcttacatttggaggacagggacaaggactgagcaaaaacaaaatgaaaaaatcatgacaaataaataattaacacaatagaacaaaactctagcacccgggccgttcataggaggccaagggaaatttatcacatggatctgtgatgtccgcctcccctaaaacctgtccccacactcctggaaggaggacagggtgtgtgaaggatgagggccagagggctgggtggcagagtttcctcttccacattgaccaaggggcccacgtggactctgccattcagtttctagtgtgcttgtctctccagacatgtggaccagctgtgttcaaaccactacccactggcatgagcctactttttgcgaatggtgcattgaaattgaacttcagattgaggatttctccttaacgatggtgcgcatctcaggagaagatcctaaagtgtcccttttaaaacatttatttgtggagaagcccgtggcctggggttgaaggcccatatggggtttgctctgctgttgccaggtgccagtctgttttcagtgaggctttggacagcagtggggcagaaggcacctgccctttaactgtcagtgaccatgctagacactgttgataccacctccccctacttccgtctccatcctcctgacctcaacaccaaaccatttctcctctgtggtgctttaaaaattgtagcaaatttttgtgtggtgcaagaatgcatggcctgcgtctattggcaaccacagcaatttaaaatccactgagctgacaagcttttttctgtcaaaatatctctctaaggcagacattgggactcatttccttgaatgcagccctgccttcaggccacagaggacttctggaggctgctctagccctgaggacttgccctgggacgtgcttccagttagaaggcttgtgtccctaccccagtgaggccaccagcttggaccactccaccctgtggctggggttttccatccttccccctacctcacaggcccgttggaggctgactgagcaaatgcctgcgaagtgcttgaattgccggggagccagcgaggtttgccttaggaagagtcttctagaaaggtgtaggttataagggagcagtcttagctgaggccctcatatgcctctgatgttgagtctccacttggagagtcaatctcccgtcagttgaccctttccatcctctcgtcctccctttccagagctccctgatgccagagatgctggtgaatgcaggtgacattctacctttcgtttccttgtctttccctcccctgggccttcagcattgcactcctgcccttcatcacaaaggggtttttggcttaagaggcccctgctttttccatgttgggggacctggggaagcctgaagctcggggctagccctggctctcccagtatttcttcaagtaggtgccagagtgtgacctgggagcaggtgagaagaaacttatcccaatatgtctactcagttagcacagagccaggcatgagctccactgatcagagccaaagggagtttgccaagaaatgcccgctgcctttggcatctgagttgcagctgggtggtaatgggagagagcaggaagaggcccaaggcctggcccatggagggcaacatgtgtccttcaggggctgaggacaggccgtgggaagagtcacaggaggttgcttaaggcctgtgatgttcggttcagatgcttcatggtgttctgccaggtggggttgcaccacggtctctgggatggtttctgcagcacattgtagaaaaaagactgtacagcacacagcaggcatcactccttgcgatgcacacttggattttatgaatgccctgtacatatcttttcaaactctgtgtttgtatggaggtggatttgatacaatgctgactctttcgtggctacatttttgctgtttttggacttctatgtgtgtgtgtgtgtgtgtgtgtgtgtgtatctatgtgtgcacgttgccttttctcattgcttatctgaaacaatagccggtgtgcagctatatttgtaccaggagggatccggtctgaaaagaggaatgtcacctcccctcgcagggctgagtagcctgatgacagggccctgagcaaggaaacgtggcattaactatattggacacccaacccccaaagttgtcactgtttgcctccttgaaaaaggctttggaagaagacaaagcagctccattctgcaggtctccaccctatgcaacccccgctcacacgcccttttggcatggtgcccctggcccaggcttctgttctgtgggtgtcagcagctgaaagaaatctgagtactcctgggcatggttttttttttttttttttttttttttttttttttttttttttttttttttttttttgtgtgtgtgtgtgtgtgtgtgtgtgtgtgtgtgtgtgtgtatggaaagatgtgtgactattgactttgggtatcgcgggactagttaattagatgtttttcatttttcaaaaagaaaaggttttaaaaattttcttgaaatgtgactgtcacttgttttcaaccaaaaactttttaagattttttaaaagaaaaatcgaaatcctgtccctcccccgcttcccatcgcctccggttttcaaaatgaaagcacaagtgcaagagtggggtgcacaggtgcctggcgtgtacacaccacccacacagctgcgtccagccctggctgagggagacgcagtgctgagcagtcagccccgggaggcctctttttcaacttccaatcccactgccatgaatgtgaattccttagggtgcttccaaaaacaggagtctgcctgatctgttggacattgcctttttggtagcccgaatatgaggaattcaggacaggaaagtgtctttttgtcaagtagtcagagccggatgcttcccctctcccagtgggtggagcatcgcaacccccagccagagttgatcttttgacaacccagtgacatcccatgagaaggaagaaaaaaaattcaacactgcctctagattgttattttgtccaagagagagatcatggagagagtctctctcgctcacggaggctctgtctttctaggagtatgtgtgtgtgctgtctcatgtgtggacactcacagttgaggctgagatggatatcttggcagcagagctgctggtctaggtggcttttcagcttgacaagtaatgaagctccatttcaggacttcatcgattccgaaacaagcacagccccccaccccccgccacggaactctactaatactaatcactataattagctaatttaaaagtacggtaatcagactgcttgcaactattttaaaagcccattaatttgaagcccactacttcagaacttcgagaaaatcacaacttaagacaattcacagtagctgtgattctggctacataaaaatatttgaaatattcttccctttagtcaatgttcagggtcttttgtgtaagagaaatccagtttaaaatgagtacccttttcaaagaaaaggctcaagatattaaggatcccttcaccgtgccttcagctttgcagttcagcacttctcgtatgtacagggtgatctcttgttctctctccatcacagggatgttggatattgcagcctttcactctactccgttatttatcctgtgaataacatagtttgtgaactagactgcaatttaaactaatacacatgatgtatctttctaaatattctgtaaagcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaacacagatcttcaggattgggacaaatcccccagctgcttttgcctctcaatccatctcccctcatcgataccaatttcccaggcctgaacacatctgttattttgctctgacattgtgaatttgtgacagtggaaaccctgatatgtgcaactgagcttatagaaataattactgtgaaatggattaattttgataccactttaaactgtgcttgtattcatgtgttgacccttgtcagctgggaaatctgtacattcagtatatgtcagcatttcattggagcctgggggcaacagacaaacttgcttctgatttctctctctctctctttctttttataattgttgaatttggctgttacattttgtctccttctttacaagaaaacaataataataaagagcaaatggcatccacttgaa

SEQ ID NO: 23758 - DNA, 650 bp, Homo sapiens
ggcgcagcagcgaggtggcgggctgcgtgcgcaaacagggcggccgccttctgggcccggagaacgagaagtgagaccctgcagctgagggagcatcatggcaggcctcagtagggctctctcctcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacggcatgtaccaccctggggctggttctgggagtaggagtagcctcaggaatagcaagaacaggccctggtaatgcagaccaatcagaagcaaggaaagacacccagcctaaggcatagccactagggccatcacggagcagataaaatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacacc

SEQ ID NO: 23759 - DNA, 379 bp, Homo sapiens
gacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccgcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaaca

SEQ ID NO: 23760 - DNA, 339 bp, Homo sapiens
gcagcgcgacgattgcggcctggcgatcggggcactgcggtcgtggcgcgcgaggcgcggggcgcgaggccagccctggaacggcggggtgtggggggcgggcagctgcggagcccccagaggaaagcaggggcaggcaggggggtgccgagagaagtgagaccctgcagctgagggagcatcatggcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaac

SEQ ID NO: 23761 - DNA, 1303 bp, Homo sapiens
aggcaggggggtgccgagagaagtgagaccctgcagctgagggagcatcatggcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacgatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacaccctcccccgggtcatggtgtaccggggtactgtgcatagccaaggggagccttctgggcaccgagaggcagcgaacagcccccaggtggtgctggggcccagtcgggggggcaggaccacagtccggctagagagcaccctctacctccctgagctctctctctccagactgtccagcaccacccctcccccctcctacgaggaggtgactgcgccccaagagagcagcagtgaggaggccagcgtgtcttacagtgacccacccccaaagtacgaggagatagtggccgccaaccctggcgctgacaagtagtgggacgtttgtgccctgtcctggatgaacgcctctttccgaggtctcctattttctttttaactttttaaagactgtgccaccacaaaacagccttagcctccttgttgccaaataattccctaactgtggagttttaggaagtcagttgtcagagacaggtggggagggtgggggtagggaccacgcatgagtcgaagcccccgggaagagccaaaggccaaagtgcccaactctttgggatgacccccaagcctccaacatcctgtctttccatcaggaactggcttctcttatgccaaaggaataaccccattgagttgattgtggccagaatgtccacaggcctggcctgggggctgtgggactggctggaggcctgcctgtgtctagagctctgggcctcaggggtaagggaaggaagccagcctttcagcaccccttaccctccacagttctgtgatttctgtccttgcttacatttggaggacagggacaaggactgagcaaaaacaaaatgaaaaaatcatgacaaataaataattaacacaatagaac

SEQ ID NO: 23762 - DNA, 5530 bp, Homo sapiens
cccggaccgaggcaggacctcaccccgcgcgtgttccccgggcgcccctctgcgaaccccaggcccttcccaggtttgcgcgcgggggccatccagaccctgcggagagcgaggcccggagcgtcgccgaggtttgagggcgccggagaccgagggcctggcggccgaaggaaccgccccaagaagagcctctggcccgggggctgctggaacatgtgcggggggacacagtttgtttgacagttgccagactatgtttacgcttctggttctactcagccaactgcccacagttaccctggggtttcctcattgcgcaagaggtccaaaggcttctaagcatgcgggagaagaagtgtttacatcaaaagaagaagcaaactttttcatacatagacgccttctgtataatagatttgatctggagctcttcactcccggcaacctagaaagagagtgcaatgaagaactttgcaattatgaggaagccagagagatttttgtggatgaagataaaacgattgcattttggcaggaatattcagctaaaggaccaaccacaaaatcagatggcaacagagagaaaatagatgttatgggccttctgactggattaattgctgctggagtatttttggttatttttggattacttggctactatctttgtatcactaagtgtaataggctacaacatccatgctcttcagccgtctatgaaagggggaggcacactccctccatcattttcagaagacctgaggaggctgccttgtctccattgccgccttctgtggaggatgcaggattaccttcttatgaacaggcagtggcgctgaccagaaaacacagtgtttcaccaccaccaccatatcctgggcacacaaaaggatttagggtatttaaaaaatctatgtctctcccatctcactgactaccttgtcattttggtataagaaatttgtgttatttgataggccgggcatggtggctcatgcctgtaatcccagcactttgggaggccaggagttcgagaccagcctggccaacatggtgaaacccggtctctactaaaaattcaaaaattacctaggcgtcatggggcatgcctgtagtcccacctacttgggaggctgaagcaggagaattgctcgaacctgggaggcagaggttgcagtaagctgagatcacgccactgcattccagcctgggcgacagagcaagactccatctcaaaaataaaataaaaaaagaaagaaagaaaagaagaagaaaagagaagaaggagaaggagatgaaggaggaggaggaggagaaggagaagaagaagaagaagaagaccacaaaagacatgactatccaactttttatgacaaactgcaaggaataaaggaagaataagtccatgtactgtaccacagaagttctgtctgcatcttggacctgaacttgatcattatcagcttgataagagactttttgactctatatccttgcagttaagaagaaagcacttttttgtaatgtttgttttaatggttcaaaaaaaatctttcttataaagagcataggtagaattagtgaactctttggatcctttgtacagataaaggttatagatttcttgtgttgaatattaaaaaagcaaggatgtctaaccattaagattatccaaagtcaggctgggcgcagtggctcacgcctgtaatcccagcactttgggagggataggtgggcggatcacctgaggtcaggagtttgagaccagcctggccaacatggcaaaaccccgtctctacaaaaatacaaaagaaattagccagacatgatggcgggtgcctctaatcccagctactggggaggctgaggtgggagaatcgcttgaactcgggaggtggaggttgtagtgaggcgagattgtgccattgcactccaacctgggcgacagagtgagactccatctcaaaaaaaaaaaaaaaaaaaaagattatccaaaaagatattggacctactctttcttaggatttttttggcggggggttagaaatacttcacagaatttgacatttcagtataaatctgtgaccttaatataatcacttggttttatatgttaaattattgcacagcagtcatcatattttgcagagtttagttcttaactcttgctgtcagtcatgttttattataggtagtggggtcagtagttttcttcttctaaaaaatactatttgctatgaagttagttcttcagaagatacaagtttgcaatgaaaaggatttgcaagggttgttatgctatcaaataaacagacctaaaatctaggagacactagaacttaatgaagttgcccctgttactgattagtaaatactcccatcttcgttgcaaaattatctctctgtataactacatatgattattttgaaatttgttaaacttcataagtaatagtttgagaatgtggaaaaagtaatttgcttttctgctcttaaaataatattgattaatgttaccagaaaccttttgcatctcttaatatgtctgaacacaaaaggaaaacaccataatcatataaacccattctttgtctcttcttctaaatcatatgtataaccagtttttccttaagaatgtagcagcatataagctataaatttctggagtatatgcacacaaatttatctgggtgggtatgtaggtatatgtgagtttgtttcctcttccaggagctcaagaaataacatactcctgaaaaatagaatagaaatttctgtgctttatgtttttgccaggctattacattttcttatcatttaggatcacttataaaatgatcattgtttattttgttttataatttttacaggagtgagactgcaaacccacatgtttgatagttcctaccaaattaaaagtttagaaagcataaatcatattacagtgcatatgtgagtgtatgtctctcttttaagatgcatcatcttaaggcagataaaagtaagtccttaatcattacagactgccaaagactttatccttttagattctcagtctctttgttgcttgttgcaaataaatcatctagcaacatttacatttaattaggaaatctaacttgcttttaaaagttacccacgttgcatataaaaatcttgctattccttgtgtcttggctttacataagcacttttgctcatgtgactttgcactttgcacttattttaatcctctttaaagggctacaggcaaattctactttgccataatcacactaaggcatggaagaacaacttgcccagaatctagcaggttggtgacaactgggtttagaatgagtgagcacacttttctagtcccatgtcatgcctataaaattacactgcctcgaattatgaaattcagggatcttgtacataattctaagtttgggacagaaatttacaagcatttctcatatatacatacatttatatatgtacatgttacatatatttagatgtattctcatatacatatgaaaatatttatgatgaatagaattataagatatgtatgtatcttgcactgaatcataatttgaaatatttcatgaattcatttacttctattgactcccaaaattctaactgcaagctagcttcagaacctgtgagaaccccaccccacccaagcagctgcctagatttgtctactgctatcattttgtgtaaagcagttgctctaacttgaatgagtctagaattcatcattaagattgtgatatttatagagcatccaatgtggagatcatgatactttaaatataaaaaggaaaatatgatagaactgttattgacaaatgcttataatgattgaagggaaagtatctcaacattgtatcagtcacatatatttctgttgctttcaccattttctattcctgttgtaagtttggtggtagatttagttttgtttggtttatctgttttgtttgtgttttgtctcctggcaattgattagtgttaatcattaaatctattttgacacaaggttttatatataattagatcagttttccactttattacaattaagaaatgagtaaaatatggatataaaaggagaattggattgaaaagacaaatacacatttacaaggtcatacctttggtaggacagacaattccatatagaatattctcttttgataatgaaaaaaattaaagagagcacaaactttgactatgtcaaagtatttttatttttaattttttgagacaaggtcttgctctgctacccaggctggagtgcagtggtgcaatcacaactcactgtagcctgaacttcggggctcaagcaatcctcccacctcagcctcctaagtagctgggaccacaggtgcacctcggtacacctggctaatttttgtgttttttgtagagacagggtttcaccatgttgcccatgctggtctctaactcctgagctcaaggaatccacccacctcggcctcccaaagtgctgggattacaggcatgagccaccacactggactgctgtgtcaaagttttgcatcttttttttttttttttccagaaggagtctcactttgtcacccaggctggagtgcagtggagtgatcatggctcactgcaacctccgcctcccaggttcaaggatttctcctgcctcagcctcctgagtagctgcattacaggcacctgccagcacgccttgcaaatttttgtatttttagtggagatggggttttgccatgttggccaggctggtctcaaactcctgacctcaggtgatccgcccgcctcagcctcccaaagggctgggattacaggcgtgagccactgtgcctggccccaagttttgcatcttttaatgccctctgaacaaatacatagagaaaactctcagaacaattaaaacctgcagagcaacagtgtcctccatgtcttaggtttcaagtttgcctctaaaattctaatccatatttttctacttctcagataatttatgtgtgtgtactcttcctagacgtacaagagactttttaatgctaaatatttgtcagtgcttaacaaaaactcaatttcacattactcatattgtttttgttttaattgaatgtgaattaaatttttattagttatttgatttggaatgttatgtatgccattaacactattaggggaatctctagcatttctgtatttttaaagaatttgattcttttgtagattctgcctgtgtggtcattttaaaacatgtgtgacatatatcagtaccttcattcttctatattttgtgtctcctccaacctccaactttttttgttttttgaaaaatgtttctctaacacctcaacagtttaaggtaatttagtacacatatatcagtatttttgtgatctgaaaaagcaacccattttctaaattcatatttttcctaaaactttactatgtttttattttaagaggtttcctgttatatacactttttacacatgcaaataaactttataccaagtgagta

SEQ ID NO: 23763 - DNA, 1080 bp, Homo sapiens
ctcctgacagttcgccccaggagcgggcgccgctggccgagatgctcctccgggacttggtgctgcgccgtggctgctgctggtcctcgctgctgctgcactgcgcgctccacccgctctggggcttcgtgcaggtgacgcatggtgagccccagaagtcctgctccaaagtgactgacagctgccgacacgtctgccagtgccggccccctcccccgctgcccccgccgcccccacccccgccacctcccagactcctctccgccccagctcccaactctacctcttgccccactgaggaaagctggtggtcggggctggtgatcatcattgccgtatgctgtgcctccctggtgtttctgactgtgcttgtcatcatttgctacaaagccataaaaaggaaccatgccatctagggagccctctgtggccatctctgcctggaccagggtggaaatgcctcttcttggtttaatgagaccagcctcagctgactcacagagctgcagagccaggctgggtcctaacaactctctctagcatttccggagccccacggggcacgcgttaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgcc

SEQ ID NO: 23764 - DNA, 3711 bp, Homo sapiens
agagctgccgcggggggaacgcggacctcttttccccgagcccagggtcggctggggccgccgccaggcaagttcgccccaggagcgggcgccgctggccgagatgctcctccgggacttggtgctgcgccgtggctgctgctggtcctcgctgctgctgcactgcgcgctccacccgctctggggcttcgtgcaggtgacgcatggtgagccccagaagtcctgctccaaagtgactgacagctgccgacacgtctgccagtgccggccccctcccccgctgcccccgccgcccccacccccgccacctcccagactcctctccgccccagctcccaactctacctcttgccccactgaggaaagctggtggtcggggctggtgatcatcattgccgtatgctgtgcctccctggtgtttctgactgtgcttgtcatcatttgctacaaagccataaaaaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgccggaaaacctctcctcctcccaggaagcctgcctgctccactgttcacattctcaacagaagccatcggcacagccagcagacagacgtcccctttcaaaggtgcttcccacacatctgttcatcgccccatctgcagttgttgtcaatcttcagggcctgccttctccctcctatccccactgacaccctacaccctaggctcctgactgcctgccatggagggctgtgagtccagcctgcagaatcccctcctgagcagacacaggagtgcgtttacactcgggggcagtgtctggccttccgggggcaaaacgactcactgaacccgcagcccagggccactgggcaagggcagaggccactgcacctgtcctcagactcatccccacacttgaccccataggaactgatgcatctgtgtgagccaggccctgccttagtcagcagaggccactacttgtgccaaatccactgtgggcctgctgtaccaggctgatgctggccaggcgctggatgtcccccacagtcccctgaggcctgactgttgtactcaggccctctcccagagtcctccatcatctccccattttaccctaccccgagccccagtcgccaagaaggaggtgttgttcttccagggtcttcctttcaatgtctgtttccacagtctcatgctatagaagcgctgagccctccagcgtggttggaggatcaagggatgaaatgggacaggaggagaggggtcctccaggctggtgacccctgccctgttggcctgtctcccaagtggcagccttccctgtgggccacatcaggaaacccacggagacagggtgattttgcatctcctggaaaatgagtgggacactcctggccccctggctctccccaccacccctacatatgtgctcagaaggagcccaatgcattgaatggttccactgtcgagccctctaagacctggtttgcctcctaaacctccagtgtgctcctctgataggtgtttaagctacaggtgagactttgaagtccagagaagacagacacacctgaaaaccggtccccatttgggccgaaccttaaaaagcccattgtcccagagtcctagtgcccacggagctgtctgtgtgtcattgtcctgcccaggtcatcaggtgtgggctgaggacaggcccagggcataccctcccataaaggggttttcttctttcctcatttccttctatttgaggacttgtttggggtttagatttgaattttgcttcccctggacacctgggcatcagcatagtgccaccccctgctcctgacctggccagtacttcacagtgctcttgaggtgcggagccagctgacaaataggccagagggtgtgggccagcagcaggttaaagggggaaacccagcagaccccaccccagggcactctcccctactgccttcagccttctggtgcctgttgaacccccaagctgtgccctaagcagacccctgggcaggaccctagccctaagcacacaccaccctgtgctgcaaccatgagaaagtgcccatgccttgggctgtccagaagctcaggagtgatcagagggcaccttctctaagaggggaggttcctggctaagggaccatggagtggtgggcagcctgaaggggctgggcacagcccagctttgcgcacactcgcctggtcccatcattccctaccttggcttaaacctaggaggcctggattttgcagttagcctaatcttccagccccaggcgaggctccctggtgaggaatcagctgagccatcaccacgttttggggcctgtatcctcttccctgagccgctgacgcatccagggctctagtctgcacataaattccctctcagctgggcttgtaaaatcccttctcaccccagttagcaaaaatcaagggaagagcctagtttttttaaaagattcacttaatatccaccccccacctcaagcccaagaccgcccattcaaaaaacaagtatacggcacagcaagggagacccactagattttgagcttacagagacataagggtacttaaaaccctgccggcctagtatttgagcttagaacttttatttaaaatgagccggcagtctctagacacacaccgatcctcaggctagtccgagccctgaggtcaagaatgaaatgcacttcccttctcattttctcaaatagatcttttccagccgtctcacagttgaccccaactttggaactcagatcataggatctcccagaggtttcaggtgttcctaagaagcttctaaaggaagttttggaagaaagactaataggtgtaaacatataaacatatatattatatatagctatatatatttaaagagatctctacatatatatatatatataaatacaactactgtactctctgcatctgtacaaagtatgagttaaactgcccaggtagtgtgagatacgtaatgcatgaatgtgaatatcctgaaatctgccttcttagcaacgtgccgcgtgtactggagagaggacagttgctcctgggagttctctcaatgggcaaatgtacaagttgatgccgtcttatccaccaacaagccattaaggttggtttcctgctgagacttttgtaccggaagcgagaccggcagcactgggggtgtccatatgccacttatgaggaagaaagcaccatgacttttttattttcaataaaaatatagagatgtc

SEQ ID NO: 23765 - DNA, 3649 bp, Homo sapiens
ctcctgacagttcgccccaggagcgggcgccgctggccgagatgctcctccgggacttggtgctgcgccgtggctgctgctggtcctcgctgctgctgcactgcgcgctccacccgctctggggcttcgtgcaggtgacgcatggtgagccccagaagtcctgctccaaagtgactgacagctgccgacacgtctgccagtgccggccccctcccccgctgcccccgccgcccccacccccgccacctcccagactcctctccgccccagctcccaactctacctcttgccccactgaggaaagctggtggtcggggctggtgatcatcattgccgtatgctgtgcctccctggtgtttctgactgtgcttgtcatcatttgctacaaagccataaaaaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgccggaaaacctctcctcctcccaggaagcctgcctgctccactgttcacattctcaacagaagccatcggcacagccagcagacagacgtcccctttcaaaggtgcttcccacacatctgttcatcgccccatctgcagttgttgtcaatcttcagggcctgccttctccctcctatccccactgacaccctacaccctaggctcctgactgcctgccatggagggctgtgagtccagcctgcagaatcccctcctgagcagacacaggagtgcgtttacactcgggggcagtgtctggccttccgggggcaaaacgactcactgaacccgcagcccagggccactgggcaagggcagaggccactgcacctgtcctcagactcatccccacacttgaccccataggaactgatgcatctgtgtgagccaggccctgccttagtcagcagaggccactacttgtgccaaatccactgtgggcctgctgtaccaggctgatgctggccaggcgctggatgtcccccacagtcccctgaggcctgactgttgtactcaggccctctcccagagtcctccatcatctccccattttaccctaccccgagccccagtcgccaagaaggaggtgttgttcttccagggtcttcctttcaatgtctgtttccacagtctcatgctatagaagcgctgagccctccagcgtggttggaggatcaagggatgaaatgggacaggaggagaggggtcctccaggctggtgacccctgccctgttggcctgtctcccaagtggcagccttccctgtgggccacatcaggaaacccacggagacagggtgattttgcatctcctggaaaatgagtgggacactcctggccccctggctctccccaccacccctacatatgtgctcagaaggagcccaatgcattgaatggttccactgtcgagccctctaagacctggtttgcctcctaaacctccagtgtgctcctctgataggtgtttaagctacaggtgagactttgaagtccagagaagacagacacacctgaaaaccggtccccatttgggccgaaccttaaaaagcccattgtcccagagtcctagtgcccacggagctgtctgtgtgtcattgtcctgcccaggtcatcaggtgtgggctgaggacaggcccagggcataccctcccataaaggggttttcttctttcctcatttccttctatttgaggacttgtttggggtttagatttgaattttgcttcccctggacacctgggcatcagcatagtgccaccccctgctcctgacctggccagtacttcacagtgctcttgaggtgcggagccagctgacaaataggccagagggtgtgggccagcagcaggttaaagggggaaacccagcagaccccaccccagggcactctcccctactgccttcagccttctggtgcctgttgaacccccaagctgtgccctaagcagacccctgggcaggaccctagccctaagcacacaccaccctgtgctgcaaccatgagaaagtgcccatgccttgggctgtccagaagctcaggagtgatcagagggcaccttctctaagaggggaggttcctggctaagggaccatggagtggtgggcagcctgaaggggctgggcacagcccagctttgcgcacactcgcctggtcccatcattccctaccttggcttaaacctaggaggcctggattttgcagttagcctaatcttccagccccaggcgaggctccctggtgaggaatcagctgagccatcaccacgttttggggcctgtatcctcttccctgagccgctgacgcatccagggctctagtctgcacataaattccctctcagctgggcttgtaaaatcccttctcaccccagttagcaaaaatcaagggaagagcctagtttttttaaaagattcacttaatatccaccccccacctcaagcccaagaccgcccattcaaaaaacaagtatacggcacagcaagggagacccactagattttgagcttacagagacataagggtacttaaaaccctgccggcctagtatttgagcttagaacttttatttaaaatgagccggcagtctctagacacacaccgatcctcaggctagtccgagccctgaggtcaagaatgaaatgcacttcccttctcattttctcaaatagatcttttccagccgtctcacagttgaccccaactttggaactcagatcataggatctcccagaggtttcaggtgttcctaagaagcttctaaaggaagttttggaagaaagactaataggtgtaaacatataaacatatatattatatatagctatatatatttaaagagatctctacatatatatatatatataaatacaactactgtactctctgcatctgtacaaagtatgagttaaactgcccaggtagtgtgagatacgtaatgcatgaatgtgaatatcctgaaatctgccttcttagcaacgtgccgcgtgtactggagagaggacagttgctcctgggagttctctcaatgggcaaatgtacaagttgatgccgtcttatccaccaacaagccattaaggttggtttcctgctgagacttttgtaccggaagcgagaccggcagcactgggggtgtccatatgccacttatgaggaagaaagcaccatgacttttttattttcaataaaaatatagagatgtc

SEQ ID NO: 23766 - DNA, 2556 bp, Homo sapiens
cggaaccggaagatggtgtgagccacgggctgccgggggcctggggctcggcgtcggtccccgggggatgtggagagctggcagcatgtcggccgagctgggagtcgggtgcgcattgcgggcggtgaacgagcgcgtgcagcaggctgtggcgcggcggccgcgggatctcccagccatccagccccggctagtggcggtcagcaaaaccaaacctgcagacatggtgatcgaggcctatggacatgggcagcgcacttttggcgagaactacgttcaggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaagagagtaaacatggccttccaccttcagagaccatagccatcgtggagcacataaacgccaagtgtcctaacctggagtttgtggggctgatgaccataggaagctttgggcatgatcttagtcaaggaccaaatccagacttccagctgttattgtccctccgggaggagctgtgtaaaaagctgaacatccctgctgaccaggttgagctgagcatgggcatgtccgcggatttccagcatgcggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctcttgggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttatttttta

SEQ ID NO: 23767 - DNA, 5747 bp, Homo sapiens
ctgggagatcagatcttctagctggctctctgctgccacagctccgccgaagggagggggtggaagaggaggactaaactcagagctgagaggagaggcaggtgtgtgcaggtgcatcacctggatcatgaggtcacccctctgctggctcctcccacttctcatcttggcctcagtggcccaaggccagccaacaagacgaccaagacccgggactgggcccgggcgcagacccaggcccaggcccaggcccacacccagctttcctcagcctgatgaaccagcagagccaacagacctgcctcctcccctccctccaggccctccatctatcttccctgactgtccccgcgaatgctactgcccccctgatttcccatctgccctctactgtgatagccgcaacctgcgaaaggtccctgtcatcccgccccgcatccattacctctatctccagaacaacttcatcactgagctcccggtggagtccttccagaatgccacaggcctgcgatggattaacctggacaacaaccgaatccgcaagatagaccagagggtgctggagaaactgcccggcctggtgttcctctacatggagaagaaccagttggaagaggtcccctcggccctgccccggaacctggagcagctgaggctgagccagaaccacatctccagaatcccgcctggtgtcttcagcaagctggagaacctgctgctcctggatctccagcacaacaggctgagcgacggcgtcttcaagcccgacaccttccatggcctcaagaacctcatgcagctcaacctggcccacaacatcctgagaaagatgccgcccagggtccccaccgccattcaccagctctacctggacagtaacaagattgagaccatccctaacggatacttcaagagctttcccaatcttgccttcattcggcttaactacaacaagctgacagacaggggactccccaagaactcctttaatatctccaacctgcttgtgctccacctgtcccacaacaggatcagcagtgtgcccgccatcaacaacaggctggaacacctgtacctcaacaacaatagcatcgagaaaatcaacggaacccagatttgccccaacgacctagtggcgttccatgacttctcctcggacctggagaacgtgccacacctgcgctacctgcggctggatggaaactacttgaagccgcccatcccgctggacctcatgatgtgcttccgcctcctgcagtccgtggtcatctaggccctactccgccaccggatctgctctgaccgcacttgaaggctggggcccaggcacctgtgccggccattcgttttctctctctccctttctttctcccagctttgcctcccttatcccaccctcgaggcagggaaaagccatctattcttctgcagcctcaggagcgagacttcaaggactcagtttggttccacccagttgaaagacacccagtgcacacccaaactcctggccttctgtggtttccctttgctccagaaacacagatgtgtctaaagacttggtgtccccttctctctcctcccccacccgccactcctgggtacatctgggccgtggactatctgatcttggtcctggccgagcaaacagcccggaggtaaggttcagaaagtccccctggggactcctccatcttcggcagctctggctcaaagaggccgagaaacccagttctcctgggccaaggatcccttctggcaaagctgctgctccgccgcttggttccccggcaccagacatcgccctggccctgctggcccgggtatcgggaaggaggagcgagggaatgacggaggtagggtgcagggtcagggctcccgcaggggcctgcatctggccagcaggacacagggatgcgcagggcgcccccttctgttccagggtgaacatagcacacgccctcctggctgggcctcaggaggaacagccaaggagaagaatggcccaaggaactaggaagcagccatgggagaggggaagggttcaagcccgggatgggcccgcgtgacgtcgatgggtcctgcggcccccttgcccaacctcgggtttagggaggagggttcacagtgtttttgtgggggcgggggaaggaagaggcagccccgcccccgccatctgttctccatcagtgtgcgcggcccagccatttccaccctcgggaggcggctcctgagaaacagggaggaaggggcggagcacctggacgtctcccagaagcccctccacgtttgaaaatgcgcctcctcctcggagacagacgcatcggtgccacctagtggctggtgggagtaacagctggtcccagtcttgcgcctggccctcttcctggggtgattttcctcggtggaggaggcccgtggggtcccaacacggaagagccatgggccgtgtgcatggtgtcgctctcctctagggtctagcgggcacaaacgtccccaggctgggctcattcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgttccgagtctgcagctccacactttaaatcatactcgaatgcaggacaagtcctaaatatttgccccttcccttgcagtaatttattttctgtatggactgtccctcccccagaggcttccccaccctccattgcctggcccaggtgagcagcttggcaggtctccaagtggaacccggtccagacagggctgcctcgacttcacctttccccctaacttcctccaagggatgctgccccttctcagccccctgcgtgtgtatattggtgggaggcatagaggatggatgttctagaaatgagtaagacacagtgcccacccccaagttaggatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagccccttctgcatcttattcacagcttgcagcctcagcccctttgatgaggccctcaggggagaggtcattaccttgatcctgcaaacccagactcgttgagcagcaacgcaatcaccatcatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcacagtacaggaaataaagtaatatgaaaaacaccctgcgtgaactcaacggtgtgaacaggtcaagaataacacttcaaagtcatcttgccagccaggcgtggtggatcacgcctgtaatcccagcactctgggaggccaaagcgggcagatcacctgaggtcaggagttcaagaccagcctggccaacatagtgaaaccccttgtttactcaaaatacaaaaattggctgggtgcggtggtacatgcctgtagtcccagctacttgggaggctgaggcaggagaattgcttgaaccctggaggcagaagttgcagtgagccgagatcgcaccactgcactccagcctaggagacaaaacgagacttcatttaaaaaaaataaaaataaaaataaaaataaagtcatcttgccacccaccccctaccattgagccaccatgcccagccccaaagcctcttaattgctctaacaagatgagtggggaaaagattatactcttaagaaattcctacgaaagctatccaaaagccttttctttcctcttttcttattatttttaaatagaggcagggtctcattatgttgcccaggctggtctggaactcctggcctcaagtgatcctcccaccttggcctccccagagtgctgggattacacacgtgagtcaccatgcccagccccaaagccatttcttgaagaatttctcgcaaactcacaaccctcatgaaaaattaatcctcagttccacgagactgcccacccacagacaaaaaaatatatatattcctaaagtcggaccagaaatctgacagctgcctttgaaacccaaagcctcgggttctttcaagctacatgtactaaattgtcgaaggtctcccaggagctctgtactgaggcagacacagaaagacacaaaacggtcgtctttcctgcccaagtaaagcttacagactaactggggagatgtagtgtgcatacaaaacagtaaaagagccatctcaaggacagagagcatagaccaagtcatctggaatggtctacatgccatgcggaagtccaccgaagggttagaacagggtgtcccagactctctcttctgagggaaggttggttgcaaaagtgggattcatgaccctcccaggctacaccatcttctttagaatgagaactgccaggtgacgccctcgctgctcctacctggctactaaacatcgacttcggttcacttcacggatgttcagtggatatcggtcacatgccaggtccccagctacgcattcaaggatggataatatacatagcagcacatccttgaggaactcataccttggtaaagggaaagaaatccatgaatggatacctctgtgtcctaagtgtttgtaataatgctgtgtgtcaggcctctgagcccaagctaagccatcatatcccctgtgacctgcatgtgcacatccagacggctggttcctaccttaactgatgatattccaccacaaaagaagtgaaaatggctggtccctgccttaactgatgacattaccttgtgaaattccttctcctggctcatcctggctcaaaagctcccccactgaacaccttgcaacccccacccctggccaccagagaacaaccccctttgactgtaattttccattacctacccacatcttataaaatggccccatccctatctcccttcgctgactcttttcggactcagcccgcctgcacccaggtgaaataaacagccttgttgctcacacaaa

SEQ ID NO: 23768 - DNA, 1710 bp, Homo sapiens
agaaagcctgttgcgtggaagataaggcggcgcgggaagtggacacaggctgcgagccttgggcagaatggatacctgaggaaaggtatggtttctctccggctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaat

SEQ ID NO: 23769 - DNA, 1584 bp, Homo sapiens
ctgttgcgtggaagataaggcggcgcgggaagtggacacagggtgggctggagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgta

SEQ ID NO: 23770 - DNA, 1717 bp, Homo sapiens
ctgattcccgggactaggttgcgggagaaagcctgttgcgtggaagataaggcggcgcgggaagtggacacagggtgggctggagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgta

SEQ ID NO: 23771 - DNA, 1742 bp, Homo sapiens
aggagccccgccccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgt

SEQ ID NO: 23772 - DNA, 1730 bp, Homo sapiens
gggagaaagcctgttgcgtggaagataaggcggcgcgggaagtggacacagggtgggctggaggtgtgcttcgcgtgtgatgccaggggagtggaaagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgta

SEQ ID NO: 23773 - DNA, 1088 bp, Homo sapiens
agaaagcctgttgcgtggaagataaggcggcgcgggaagtggacacagggtgggctggaggtgtgcttcgcgtgtgatgccaggggagtggaaaggtggcttggggagtgcagaaccctgaggatagtggcggggaggaagatggggcgtgcaggccgcccccagtgaggagaggccaggatgcagggcggctccagggcaatctgggcagttgggggagccctccgtatcgttcccggaggtagcaggagtagctgtgcgggaggtgccactcctgggcgcttgctttgcctccagcatgacccccgaccctggcttgcaccctgaatctagctgcgagccttgggcagaatggatacctgaggaaaggtatggtttctctccggctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcggg

SEQ ID NO: 23774 - DNA, 835 bp, Homo sapiens
agaaagcctgttgcgtggaagataaggcggcgcgggaagtggacacaggctgcgagccttgggcagaatggatacctgaggaaaggtatggtttctctccggctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacg

SEQ ID NO: 23775 - DNA, 1827 bp, Homo sapiens
aggagccccgccccctcggagctgattcccgggactaggttgcgggagaaagcctgttgcgtggaagataaggcggcgcgggaagtggacacagggtgggctggagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggtgagtgggagtggggagtttgtgggattgaccctgaaatttctccacccctctccaccaggcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgt

SEQ ID NO: 23776 - DNA, 351 bp, Homo sapiens
agctgggccgggtgccagatactgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggcaccaaggcctggatggagtcccgagcccgaccatga

SEQ ID NO: 23777 - DNA, 780 bp, Homo sapiens
agctgggccgggtgccagatactgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaacagggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccatgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccgggcgcggtggctcacctctgtaatcccagcacttttagaggccgaggcaggcggatcacctgaaatcaggagttccagaccagcctgggcaacatggtgaaaccccgtctctactaaaaatacaaaaattagccggg

SEQ ID NO: 23778 - DNA, 971 bp, Homo sapiens
tcttcctcagtcgtgtggcaggccctgagcaggcagctgggtgtccccgctcagatccaggcccgagtgggctgggcggctgcagagccagtcacctgagctacccagggtgggatccctggccccgacctctgtcctgacacgccccaagcggcagcaacaaagccccaattggcctgggcctgggcaggaggagctgggccgggtgccagatactgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccatgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccgggcgcggtggctcacctctgtaatcccagcacttttagaggccgaggcaggcggatcacctgaaatcaggagttccagaccagcctgggcaacatggtgaaaccccgtctctactaaaaatacaaaaattagccggg

SEQ ID NO: 23779 - DNA, 750 bp, Homo sapiens
agctgggccgggtgccagatactgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggcaccaaggcctggatggagaccgaggacaccctgggccatgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccgggcgcggtggctcacctctgtaatcccagcacttttagaggccgaggcaggcggatcacctgaaatcaggagttccagaccagcctgggcaacatggtgaaaccccgtctctactaaaaatacaaaaattagccggg

SEQ ID NO: 23780 - DNA, 6861 bp, Homo sapiens
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggtgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaa

SEQ ID NO: 23781 - DNA, 4303 bp, Homo sapiens
ttcttcaggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcctcccccttcccctggtcccctgtccctggggctgtttgttaaaaaagagtaataaaaggattt

SEQ ID NO: 23782 - DNA, 6893 bp, Homo sapiens
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggtgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaa

SEQ ID NO: 23783 - DNA, 6893 bp, Homo sapiens
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcagttacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaa

SEQ ID NO: 23784 - DNA, 6861 bp, Homo sapiens
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcagttacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaa

SEQ ID NO: 23785 - DNA, 6893 bp, Homo sapiens
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 23786 - DNA, 6893 bp, Homo sapiens
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgctggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 23787 - DNA, 6893 bp, Homo sapiens; identical to SEQ ID NO: 23783

SEQ ID NO: 23788 - DNA, 6873 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggtgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcaattacatccaaacagtggaggcgccctgggacaccctcactgcacccttacagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggattt

SEQ ID NO: 23789 - DNA, 6893 bp, Homo sapiens
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcagttacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 23790 - DNA, 6861 bp, Homo sapiens; identical to SEQ ID NO: 23784

SEQ ID NO: 23791 - DNA, 6893 bp, Homo sapiens
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctacccccgggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggatttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 23792 - DNA, 6840 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggtgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcaattacatccaaacagtggaggcgccctgggacaccctcactgcacccttacagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggattt

SEQ ID NO: 23793 - DNA, 6861 bp, Homo sapiens
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcagttacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 23794 - DNA, 6861 bp, Homo sapiens
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgctggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 23795 - DNA, 6861 bp, Homo sapiens
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctacccccgggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggatttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 23796 - DNA, 6861 bp, Homo sapiens
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 23797 - DNA, 6873 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcaattacatccaaacagtggaggcgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattt

SEQ ID NO: 23798 - DNA, 1972 bp, Homo sapiens
gttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctgg

SEQ ID NO: 23799 - DNA, 6840 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcagttacatccaaacagtggaggcgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggattt

SEQ ID NO: 23800 - DNA, 6873 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcagttacatccaaacagtggaggcgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggattt

SEQ ID NO: 23801 - DNA, 1972 bp, Homo sapiens; identical to SEQ ID NO: 23798

SEQ ID NO: 23802 - DNA, 1972 bp, Homo sapiens; identical to SEQ ID NO: 23798

SEQ ID NO: 23803 - DNA, 4303 bp, Homo sapiens
ttcttcaggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcagttacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcctcccccttcccctggtcccctgtccctggggctgtttgttaaaaaagagtaataaaaggattt

SEQ ID NO: 23804 - DNA, 6840 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgctggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcaattacatccaaacagtggaggcgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattt

SEQ ID NO: 23805 - DNA, 6840 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcagttacatccaaacagtggaggcgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattt

SEQ ID NO: 23806 - DNA, 6840 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcaattacatccaaacagtggaggcgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattt

SEQ ID NO: 23807 - DNA, 6840 bp, Homo sapiens; identical to SEQ ID NO: 23799

SEQ ID NO: 23808 - DNA, 6840 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcaattacatccaaacagtggaggcgccctgggacaccctcactgcacccttacagatcacagcccctatacctacccccgggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggatttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattt

SEQ ID NO: 23809 - DNA, 4303 bp, Homo sapiens
ttcttcaggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcctcccccttcccctggtcccctgtccctggggctgtttgttaaaaaagagtaataaaaggattt

SEQ ID NO: 23810 - DNA, 6873 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcaattacatccaaacagtggaggcgccctgggacaccctcactgcacccttacagatcacagcccctatacctacccccgggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggatttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattt

SEQ ID NO: 23811 - DNA, 6873 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgctggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcaattacatccaaacagtggaggcgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattt

SEQ ID NO: 23812 - DNA, 4303 bp, Homo sapiens
ttcttcaggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcctcccccttcccctggtcccctgtccctggggctgtttgttaaaaaagagtaataaaaggattt

SEQ ID NO: 23813 - DNA, 4303 bp, Homo sapiens
ttcttcaggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctacccccgggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggatttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcctcccccttcccctggtcccctgtccctggggctgtttgttaaaaaagagtaataaaaggattt

SEQ ID NO: 23814 - DNA, 6873 bp, Homo sapiens; identical to SEQ ID NO: 23800

SEQ ID NO: 23815 - DNA, 4303 bp, Homo sapiens; identical to SEQ ID NO: 23803

SEQ ID NO: 23816 - DNA, 6873 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagccgccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtcccgctcccccaccaccaggagccccaccttcccagccccagcccgcttcactcccggggtgggcgagtcttcactcccagaggggatctcgccggggccgaggaggagggagcctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggacatggactctcagttacatccaaacagtggaggcgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattt

SEQ ID NO: 23817 - DNA, 1972 bp, Homo sapiens; identical to SEQ ID NO: 23798

SEQ ID NO: 23818 - DNA, 1972 bp, Homo sapiens; identical to SEQ ID NO: 23798

SEQ ID NO: 23819 - DNA, 4303 bp, Homo sapiens; identical to SEQ ID NO: 23803

SEQ ID NO: 23820 - DNA, 2065 bp, Homo sapiens
tgttccgcgatcttctcaggctctcctagcagcatccatcgccgccaccctatcttcactggcttcattcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacaga

SEQ ID NO: 23821 - DNA, 599 bp, Homo sapiens
tattgacgtggaaagttgtggtcctctttcgtgtcgtgtcttgcttactaccgcgttacaagtgttggtagtgcagtgatctagtggattaccttacgcttttccatcctttcaagacttcctataaggcccacttaagttgggaaagattaaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttaga

SEQ ID NO: 23822 - DNA, 816 bp, Homo sapiens
gttgctgcgccgccaccgcccgagtcatgttccgcgatcttctcaggctctcctagcagcatccatcgccgccaccctatcttcactggcttcattcaccttctccttctctcttcgttgctgagcgacaagcttcctagcgctatgactgtcgtctccgtcccgcagcgggagccgctcgtcctgggtggccgccttgcgccgcttggcttttcctcccgaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtatta

SEQ ID NO: 23823 - DNA, 2416 bp, Homo sapiens
ctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaa

SEQ ID NO: 23824 - DNA, 814 bp, Homo sapiens
gtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcagacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaat

SEQ ID NO: 23825 - DNA, 775 bp, Homo sapiens
agcacagagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggaccatccccacaaggaggcaacaagccccagggccccccacctcctccaggaaagccacaaggaccacccccacaaggaggcaacaaacctcaaggtcccccacctccaggaaagccacaaggaccacccccacaaggggacaagtcccgaagtccccgatctcctccaggaaaaccacaaggaccacccccacaaggaggaaagccacaaggaccacccccacaaggaggcaacaaacctcaaggtcccccacctccaggaaagccacaaggaccacccgcacaaggaggcagcaagtcccaaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 23826 - DNA, 710 bp, Homo sapiens
agagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggaccatccccacaaggaggcaacaagccccagggccccccacctcctccaggaaagccacaaggaccacccccacaaggaggcaacaaacctcaaggtcccccacctccaggaaagccacaaggaccacccccacaaggggacaagtcccgaagtccccgatctcctccaggaaaaccacaaggaccacccccacaaggaggaaagccacaaggaccacccgcacaaggaggcagcaagtcccaaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 23827 - DNA, 774 bp, Homo sapiens
gcacagagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggaccatccccacaaggaggcaacaagccccagggccccccacctcctccaggaaagccacaaggaccacccccacaaggaggcaacaaacctcaaggtcccccacctccaggaaagccacaaggaccacccccacaaggggacaagtcccgaagtccccgatctcctccaggaaaaccacaaggaccacccccacaaggaggaaagccacaaggaccacccccacaaggaggcaacaaacctcaaggtcccccacctccaggaaagccacaaggaccacccgcacaaggaggcagcaagtcccaaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 23828 - DNA, 1427 bp, Homo sapiens
cacagagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggagcacccccacaaggaggcaacaaacctcaaggtcccccatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggcaaccagcctcaaggtcctccacctcctccaggaaagccacaaggaccacccccacaaggaggcaacaaacctcaaggtcccccacctccaggaaagccacaaggaccacccccacaaggagacaacaagtcccgaagttctcgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggagacaacaagtcccaaagtgcccgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggaggcagcaagtcccgaagttctcgatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaatgccatgacattggaaaaaggtcatcatagctctaacttctgtataccaataaaataattagcttgc

SEQ ID NO: 23829 - DNA, 913 bp, Homo sapiens
cagagttgggagtgactccagagcctccagcgagatgctgctgattctgctgtcagtggccctgctggccctgagctcagctgagagttcaagtgaagatgtcagccaggaagaatctctcttcctaatatcaggaaagccagaaggacgacgcccacaaggaggaaaccagccccaacgtcccccacctcctccaggaaagccacaaggaccacccccacaaggaggaaaccagtcccaaggtcccccacctcctccaggaaagccagaaggacgacccccacaaggaggcaaccagtcccaaggtcccccacctcatccaggaaagccagaaagaccacccccacaaggaggaaaccagtcccaaggtaccccacctcctccaggaaagccagaaagaccacccccacaaggaggcaaccagtcccaccgtcccccacctcctccaggaaagccagaaagaccacccccacaaggaggtaaccagtcccaaggtcccccacctcatccaggaaagccagaaggaccacccccacaggaaggaaacaagtcccgaagtgcccgatctcctccaggaaagccacaaggaccaccccaacaagaaggcaacaagcctcaaggtcccccacctcctggaaagccacaaggcccacccccagcaggaggcaatccccagcagcctcaggcacctcctgctggaaagccccaggggccacctccacctcctcaagggggcaggccacccagacctgcccagggacaacagcctccccagtaatctaggattcaatgacaggaagtgaataagaagatatcagtgaattcaaataattcaattgctacaaatgccgtgacattggaacaaggtcatcatagctctaactttaatataccaataaaataatcagcttgc

SEQ ID NO: 23830 - DNA, 796 bp, Homo sapiens
cagagttgggagtgactccagagcctccagcgagatgctgctgattctgctgtcagtggccctgctggccctgagctcagctgagagttcaagtgaagatgtcagccaggaagaatctctcttcctaatatcaggaaagccagaaggacgacgcccacaaggaggaaaccagccccaacgtcccccacctcctccaggaaagccacaaggaccacccccacaaggaggaaaccagtcccaaggtcccccacctcctccaggaaagccagaaggacgacccccacaaggaggcaaccagtcccaaggtcccccacctcatccaggaaagccagaaagaccacccccacaaggaggaaaccagtcccaaggtaccccacctcctccaggaaagccagaaagaccacccccacaaggaggcaaccagtcccaccgtcccccacctcctccaggaaagccagaaagaccacccccacaaggaggtaaccagtcccaaggtcccccacctcatccaggaaagccagaaggaccacccccacaggaaggaaacaagtcccgaagtgcccgatctcctccaggaaagccacaaggaccaccccaacaagaaggcaacaagcctcaaggtcccccacctcctggaaagccacaaggcccacccccagcaggaggcaatccccagcagcctcaggcacctcctgctggaaagccccaggggccacctccacctcctcaagggggcaggccacccagacctgcccagggacaacagcctccccagtaatctaggattcaatgacag

SEQ ID NO: 23831 - DNA, 586 bp, Homo sapiens
gcacagagttgggagtgactccagagcctccagcgagatgctgctgattctgctgtcagtggccctgctggccctgagctcagctgagagttcaagtgaagatgtcagccaggaagaatctctcttcctaatatcaggaaagccagaaggacgacgcccacaaggaggaaaccagccccaacgtcccccacctcctccaggaaagccacaaggaccacccccacaaggaggaaaccagtcccaaggtcccccacctcctccaggaaagccagaaggacgacccccacaaggaggcaaccagtcccaaggtcccccacctcatccaggaaagccagaaagaccacccccacaaggaggaaaccagtcccaaggaaagccacaaggaccaccccaacaagaaggcaacaagcctcaaggtcccccacctcctggaaagccacaaggcccacccccagcaggaggcaatccccagcagcctcaggcacctcctgctggaaagccccaggggccacctccacctcctcaagggggcaggccacccagacctgcccagggacaacagcctccccagtaatctaggattcaa

SEQ ID NO: 23832 - DNA, 603 bp, Homo sapiens
agcacaaagttgggagtgacaccagagcctcctgcaagatgcttctgattctgctgtcagtggccctgctggccttcagctcagctcaggatttaaatgaagatgtcagccaggaagatgttcccctcgtaatatcagatggaggagactctgagcagttcctagatgaggagcgtcagggaccacctttgggaggacagcaatctcaaccctctgctggtgatgggaaccaggatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagataacagtgtttcaaatgccgtgaaacatgg

SEQ ID NO: 23833 - DNA, 1864 bp, Homo sapiens
cataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgataggaagtgaataagaagatgacagtgtttcaaatgccttgaaacataatgtgatcatgctctaacttcaatataccaataaaataatcagcttgcaatttctgattatagcatctccttctgagtgtttgggactctggaatctgagacccatgttcacattgtaagaacatccaggaccccttctccttgatgtttccagcaagcttctttcctccttatccttattaagtcatctgcctggggaaggagttccactgtttctttccttctctgtcttcttagctcgaatttaaattgcacaattattttcaggtcatttcctgatagtctagtcagcttatgaatgtaagcaaaacaggaccaatgaaagaaagtcccagaagctgagagaaactttaacaagtttgagagtaacttattttgttttctaggaaagtgagtatggttctatgcctgtattccccagaagccactagacctattttcccctattttatcactgatcagttctgtccctgcctatgattcttaccattcttaagaaaacctgaatggatttcatcaaggcggcagcataatttgaagggcaattgcgtgtgaaaattgatgtgacttgatttacacaatagtcagaaaacattttagaaattgatgactttataatgcaaccaggagtattgaaaaaaaagtaagcaatgagctcaaataattaaaaaagagagacaaaatacacttgggagaacagaaataagaattaatgaaaatttaaaagattaaatgaatgagaagaaatgattcataaattttgaactaacagtaataacttcttgaaaatccaataaaattggcaaaagattgtgaaaattctggaagaataagggaaacagataatcttcagagtaatcaggtaaagcttaaacaagtgttttaaaagatgagtttttcctacattctgaaaagcaaacatgaaaaactgaacacagtttttacagatatacaatatggagtgacttatatacaaaatgaccttaaaaatatattaaactcattatagtagttaatatctaagtaaaatatgatgaaatttaatagagaattcactcctcccaaaagcaccttcatggaagattcctcattaacaggcagtcctttagtatgctgatttatacaaaatgctgaaaagaagagaaataccccaagttcttgaaaaaaaattttttgatatgactactctaacagtaataactataaatctcactttaaataatttaaaacaaattaaagtgatatatgagttaaatgaccaagcagacttgattccaggaatgttaaggaatgttcattatttgttttggataatgaagtcagcagaggaaaaaaaaatatgaccatctcaaaagatgccaacgttgtctttgataatatttaatatattttttaaaaaacaattcttgtaaaatacttttttgattagccttctgaccatgattaaaatggtgtacctcaaagtagctgctaaccttatgtgtatctgcaacaccctg

SEQ ID NO: 23834 - DNA, 641 bp, Homo sapiens
agcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgataggtatgattccagtttattatccatcaaaggctccaactgctacagttctccaacttcattgtgccagtgaatctattgaaaagc

SEQ ID NO: 23835 - DNA, 673 bp, Homo sapiens
agcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgataggaagtgaataagaagatgacagtgtttcaaatgccttgaaacataatgtgatcatgctctaacttcaatataccaataaaataatcagcttgcaatttctgattatagcatctcct

SEQ ID NO: 23836 - DNA, 3000 bp, Homo sapiens
agctgacttgctccctcccgggctgcggctgctgcaaaagccagcagcggcagcgggagctgtccggaggccggcgtcgaggtgagacccgggcagactgaggctgcggggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggagtaatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgag

SEQ ID NO: 23837 - DNA, 2549 bp, Homo sapiens
gggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgaga

SEQ ID NO: 23838 - DNA, 1798 bp, Homo sapiens
acaaaccttcctgcgcaggcctcgggctgcctgcctgcctgcctgcctggcccggcccgagctccagcctgcctcttccactggccactgcctcccacccagggctggcatccctgctccctgccctgggtcccagactgtgtcctccatcaccgcagggtcggtgaggggctgggctggacaccagggcccgccctcccatcactgagctccactccttcctcattttgctgctgattctagccccaaacaaaacaggttgagctttttcctcccctcagaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccggtgaggtccggcttgcggacagcgcagcctctaggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttc

SEQ ID NO: 23839 - DNA, 1896 bp, Homo sapiens
tgtgggcgagggccctgtgcctgccccgggggaggttgcacaaaccttcctgcgcaggcctcgggctgcctgcctgcctgcctgcctggcccggcccgagctccagcctgcctcttccactggccactgcctcccacccagggctggcatccctgctccctgccctgggtcccagactgtgtcctccatcaccgcagggtcggtgaggggctgggctggacaccagggcccgccctcccatcactgagctccactccttcctcattttgctgctgattctagccccaaacaaaacaggttgagctttttcctcccctcagaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccgctccggtgccctaccagaactattacgatcgggaggtcaccccgctgaccagcagccctggcatacagccgtcctgcggcatgataaagaggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttctc

SEQ ID NO: 23840 - DNA, 2844 bp, Homo sapiens
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatctttttt

SEQ ID NO: 23841 - DNA, 2727 bp, Homo sapiens
agcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagcaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaa

SEQ ID NO: 23842 - DNA, 2695 bp, Homo sapiens
agcgggctgagggtaggaagtagccgctccgagtggaggcgactgggggctgaagagcgcgccgccctctcgtcccactttccagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaa

SEQ ID NO: 23843 - DNA, 2844 bp, Homo sapiens
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagcaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatctttttt

SEQ ID NO: 23844 - DNA, 2937 bp, Homo sapiens
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccagagatgaagtcttgctatgttgcccggcctggtctcaaactcctgagctcaagtgatcctctttccttggcctcccaaagtactgggattacaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagcaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatctttttt

SEQ ID NO: 23845 - DNA, 2790 bp, Homo sapiens
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacagaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatctttttt

SEQ ID NO: 23846 - DNA, 2230 bp, Homo sapiens
ggaggcgccgagctgaccgggcgacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggaatgatgagcgagatactttcaagcatttagggacggggaatcgtgtggctactttcttaaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaa

SEQ ID NO: 23847 - DNA, 2313 bp, Homo sapiens
atgaagggcgcgggcggccagctccggctccggctccggctccggctcccgcgaggccgggtagcctgggcgttcccaggggtcgcagaggacggcgaaccccggcggagccaccggagctggggaccaggacgcaggcaggcgtgtggagcgtgaggtggggacgtggcggcggctcaagtgggcggagccccggcagcggcccgaggcggagtcgccaagggaggaggcgccgagctgaccgggcgacgccgcgggaggttctggaaacgccgggagctgcgagtgtccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaa

SEQ ID NO: 23848 - DNA, 2223 bp, Homo sapiens
ctggaaacgccgggagctgcgagtgtccagacatccttgtggaaccagcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaa

SEQ ID NO: 23849 - DNA, 2563 bp, Homo sapiens
agcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctt

SEQ ID NO: 23850 - DNA, 2569 bp, Homo sapiens
agcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggaatgatgagcgagatactttcaagcatttagggacggggaatcgtgtggctactttcttaaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctt

SEQ ID NO: 23851 - DNA, 568 bp, Homo sapiens
gcatttgggttgcagctgggagcttggcagagattctgcctgatgagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatga

SEQ ID NO: 23852 - DNA, 3349 bp, Homo sapiens
aaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggaatgatgagcgagatactttcaagcatttagggacggggaatcgtgtggctactttcttaaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaagagccttacttggagtatttttaagactggaagcttttaccaggttcatcatttcctatgcatcaccttcatgcaggcagagtctggataatgaatgctttagcagcaaaaaagcatcttgggtcttggatttcagacctggtttcaacacttgtgttccctctaagtgtcagtgtccttttctggaaagtagggtaaatagtttctctttgtctcccagagaacatagcacatgtgttcatgattgtaatgctgttataatgtgtacttcatttttaaattttgagataagaattgttcatgatacacagatgtatacttaaaaaaatatgaaggtgagcaggagcacctgtgtcaacaccaagttagaaaagagaacgttttcaagtcagtacctcaggagccccttgggaacccctcctagatcacatctccttcactgcccccagcactttggagataaatcattgtctcatgatgtgtggtactcattcctttgcttgtctttatagttttaccatctatgattagatccctaaataagtagttattctgttttccctgattttgaacttttactaatagaatgagagtaaatatttttgggtatgtggcttcttttgttcaacattgttttaagattcatccgtgttgcttgtgtagctgtaatttgttttaatctttatagtacattcagttttgttaatgcttattgtaggactgtaccataatacaggcagcatgctgctgataaacactggaattgatttca

SEQ ID NO: 23853 - DNA, 582 bp, Homo sapiens
cgtaatgaccaatgtttgacccctagatgccaagatattcatcagcaagatctttaaacaatgcctgtagaatagaaaactcttcataaagatgcttatttaacctctccagtggtcacgagtcttggcaagaaagtctgaagacgggaccagctgcacatgttttaccctaagagcttgctatataaaggatactttctggaaggctggttggtgtgaggattcagtcttgcagccactcgagacatcacttctgttcacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggagga

SEQ ID NO: 23854 - DNA, 1023 bp, Homo sapiens
tccaggtgagcgccccgcccgctcagccgccagatcaaccttagcgctggggcgcgggctggggtcgccaggcggtgcgttctgcccgcgcggggctgagagttaggggccggggccggatccggggccgggggtcgcgccgctagccgccagcagcgcagtccgggccgccaccctgcaccctccgccctgtttctgcacccgtctgggttcttgtgccgccgcccgcaagccttcccgagctcagggtggtgagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaa

SEQ ID NO: 23855 - DNA, 568 bp, Homo sapiens
gacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgtgattgtcattgaatgcctttcagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaa

SEQ ID NO: 23856 - DNA, 751 bp, Homo sapiens
tattggctaagcccgttctgcaccctcccaagggctgggagtcctaggtcttgtccgggcagggtccagcttggagcccattagatgggccattggatcagaaagtcttttctcccccagacatccttgtggaaccagcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggaccc

SEQ ID NO: 23857 - DNA, 427 bp, Homo sapiens
aggcagggaaatccgtcagcctccagggacgctctccctacagccccggcgaggggatcgggtcgtggcgacctctccagacgcccaggggctgggcaggagggcgggccaaggcccgcagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtgga

SEQ ID NO: 23858 - DNA, 866 bp, Homo sapiens
ctcactgcagcctcgaactcctgggctcaaggggtcctcccacctcagccttctgagtagtttggactataggtgcatgccgccacagctggctattttttttttcatttttattttttctagagagggggtctcgctatgttgcccagtggtcacgagtcttggcaagaaagtctgaagacgggaccagctgcacatgttttaccctaagagcttgctatataaaggatactttctggaaggctggttggtgtgaggattcagtcttgcagccactcgagacatcacttctgttcacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcat

SEQ ID NO: 23859 - DNA, 819 bp, Homo sapiens
gggcgacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagagggga

SEQ ID NO: 23860 - DNA, 2274 bp, Homo sapiens
gccgcgcggccaggactgtctgaggggaagttcgcgagcgctggctatgggtcctggggcgcggctggcggcgctgctggcggtgctggcgctcgggacaggagacccagaaagggctgcggctcggggcgacacgttctcggcgctgaccagcgtggcgcgcgccctggcgcccgagcgccggctgctggggctgctgaggcggtacctgcgcggggaggaggcgcggctgcgggacctgactagattctacgacaaggtactttctttgcatgaggattcaacaacccctgtggctaaccctctgcttgcatttactctcatcaaacgcctgcagtctgactggaggaatgtggtacatagtctggaggccagtgagaacatccgagctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccgggcaggaaatgtttcgtgtgccctcagcctctctcgggagtttcttctctacagcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggctacagaggtcagtggtggcatcaggggagaagcagttacaagtggagtaccgcatcagcaaaagtgcctggctgaaggacactgttgacccaaaactggtgaccctcaaccaccgcattgctgccctcacaggccttgatgtccggcctccctatgcagagtatctgcaggtggtgaactatggcatcggaggacactatgagcctcactttgaccatgctacgtcaccaagcagccccctctacagaatgaagtcaggaaaccgagttgcaacatttatgatctatctgagctcggtggaagctggaggagccacagccttcatctatgccaacctcagcgtgcctgtggttaggaatgcagcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctggggtaggagaggagaaagcagagcagcctcctggaagaaggccttgtcagctttgtctgtgcctcgcaaatcagaggcaagggagaggttgttaccaggggacactgagaatgtacatttgatctgccccagccacggaagtcagagtaggatgcacagtacaaaggaggggggagtggaggcctgagagggaagtttctggagttcagatactctctgttgggaacaggacatctcaacagtctcaggttcgatcagtgggtcttttggcactttgaaccttgaccacagggaccaagaagtggcaatgaggacacctgcaggaggggctagcctgactcccagaactttaagactttctccccactgccttctgctgcagcccaagcagggagtgtccccctcccagaagcatatcccagatgagtggtacattatataaggattttttttaagttgaaaacaactttcttttctttttgtatgatggttttttaacacagtcattaaaaatgtttataaatcatt

SEQ ID NO: 23861 - DNA, 2248 bp, Homo sapiens
gtctgaggggaagttcgcgagcgctggctatgggtcctggggcgcggctggcggcgctgctggcggtgctggcgctcgggacaggagacccagaaagggctgcggctcggggcgacacgttctcggcgctgaccagcgtggcgcgcgccctggcgcccgagcgccggctgctggggctgctgaggcggtacctgcgcggggaggaggcgcggctgcgggacctgactagattctacgacaaggtactttctttgcatgaggattcaacaacccctgtggctaaccctctgcttgcatttactctcatcaaacgcctgcagtctgactggaggaatgtggtacatagtctggaggccagtgagaacatccgagctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccgggcaggaaatgtttcgtgtgccctcagcctctctcgggagtttcttctctacagcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggctacagaggtcagtggtggcatcaggggagaagcagttacaagtggagtaccgcatcagcaaaagtgcctggctgaaggacactgttgacccaaaactggtgaccctcaaccaccgcattgctgccctcacaggccttgatgtccggcctccctatgcagagtatctgcaggtggtgaactatggcatcggaggacactatgagcctcactttgaccatgctacgtcaccaagcagccccctctacagaatgaagtcaggaaaccgagttgcaacatttatgatctatctgagctcggtggaagctggaggagccacagccttcatctatgccaacctcagcgtgcctgtggttaggcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctggggtaggagaggagaaagcagagcagcctcctggaagaaggccttgtcagctttgtctgtgcctcgcaaatcagaggcaagggagaggttgttaccaggggacactgagaatgtacatttgatctgccccagccacggaagtcagagtaggatgcacagtacaaaggaggggggagtggaggcctgagagggaagtttctggagttcagatactctctgttgggaacaggacatctcaacagtctcaggttcgatcagtgggtcttttggcactttgaaccttgaccacagggaccaagaagtggcaatgaggacacctgcaggaggggctagcctgactcccagaactttaagactttctccccactgccttctgctgcagcccaagcagggagtgtccccctcccagaagcatatcccagatgagtggtacattatataaggattttttttaagttgaaaacaactttcttttctttttgtatgatggttttttaacacagtcattaaaaatgtttataaatca

SEQ ID NO: 23862 - DNA, 2576 bp, Homo sapiens
cgagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 23863 - DNA, 2022 bp, Homo sapiens
cgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagta

SEQ ID NO: 23864 - DNA, 1737 bp, Homo sapiens
tttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttc

SEQ ID NO: 23865 - DNA, 2905 bp, Homo sapiens
ctgctttctgcacgtcctcgccgccgcgccgccagtccgtttgtgctagctctggccgtgagccggccgcccgctgccgccggccgccccgcagctgcctgcgccccagccgcgcctcgcggccagcccggctagctcaggtccgctcccggagcccgcgcccctccacgctgccccctgcctgtccccggccatgctgtcccttcagtaccccgacgtgtaccgcgacgagaccgccgtacaggattatcatggtcataaaatttgtgacccttacgcctggcttgaagaccccgacagtgaacagactaaggcctttgtggaggcccagaataagattactgtgccatttcttgagcagtgtcccatcagaggtttatacaaagagagaatgactgaactatatgattatcccaagtatagttgccacttcaagaaaggaaaacggtatttttatttttacaatacaggtttgcagaaccagcgagtattatatgtacaggattccttagagggtgaggccagagtgttcctggaccccaacatactgtctgacgatggcacagtggcactccgaggttatgcgttcagcgaagatggtgaatattttgcctatggtctgagtgccagtggctcagactgggtgacaatcaagttcatgaaagttgatggtgccaaagagcttccagatgtgcttgaaagagtcaagttcagctgtatggcctggacccatgatgggaagggaatgttctacaactcataccctcaacaggatggaaaaagtgatggcacagagacatctaccaatctccaccaaaagctctactaccatgtcttgggaaccgatcagtcagaagatattttgtgtgctgagtttcctgatgaacctaaatggatgggtggagctgagttatctgatgatggccgctatgtcttgttatcaataagggaaggatgtgatccagtaaaccgactctggtactgtgacctacagcaggaatccagtggcatcgcgggaatcctgaagtgggtaaaactgattgacaactttgaaggggaatatgactacgtgaccaatgaggggacggtgttcacattcaagacgaatcgccagtctcccaactatcgcgtgatcaacattgacttcagggatcctgaagagtctaagtggaaagtacttgttcctgagcatgagaaagatgtcttagaatggatagcttgtgtcaggtccaacttcttggtcttatgctacctccatgacgtcaagaacattctgcagctccatgacctgactactggtgctctccttaagaccttcccgctcgatgtcggcagcattgtagggtacagcggtcagaagaaggacactgaaatcttctatcagtttacttcctttttatctccaggtatcatttatcactgtgatcttaccaaagaggagctggagccaagagttttccgagaggtgaccgtaaaaggaattgatgcttctgattaccagacagtccagattttctaccctagcaaggatggtacgaagattccaatgttcattgtgcataaaaaaggcataaaattggatggctctcatccagctttcttatatggctatggcggcttcaacatatccatcacacccaactacagtgtttccaggcttatttttgtgagacacatgggtggtatcctggcagtggccaacatcagaggaggtggcgaatatggagagacgtggcataaaggtggtatcttggccaacaaacaaaactgctttgatgactttcagtgtgctgctgagtatctgatcaaggaaggttacacatctcccaagaggctgactattaatggaggttcaaatggaggcctcttagtggctgcttgtgcaaatcagagacctgacctctttggttgtgttattgcccaagttggagtaatggacatgctgaagtttcataaatataccatcggccatgcttggaccactgattatgggtgctcggacagcaaacaacactttgaatggcttgtcaaatactctccattgcataatgtgaagttaccagaagcagatgacatccagtacccgtccatgctgctcctcactgctgaccatgatgaccgcgtggtcccgcttcactccctgaagttcattgccacccttcagtacatcgtgggccgcagcaggaagcaaagcaaccccctgcttatccacgtggacaccaaggcgggccacggggcggggaagcccacagccaaagtgatagaggaagtctcagacatgtttgcgttcatcgcgcggtgcctgaacgtcgactggattccataaacagttttcgtgcttcctcctgacagcgacagaaaacctcaagggctttcccacgttgacaccaagaaaccactgggcataatgcttccccacgggaacattattcctgcactcacaggctacagttgaacagaactgccgtgggaattttatcttttttaggcttctcctttttagcaaggccttggtgtttctttttccaccctgtctaggcacatgtggttttttggtgttttttttaagggcatgttgggataaatagctaaatggcaacaaacacattgtgaatattagattgctgaattaaggatcatagtcgggcatacttatctatatccataacctctatatctttaaataaatgtgagaactgttctcatggagaagacttctttgcaacaataataaatgttatttaagaatgacaggcttttacttccggtttcttcatattgaggggcaactccagaagtggagttttctgtgagaataaagcatttcacctttctgcaacaagttagttttcaagcagttaagtcatagaatgtttgttagctttgaaaataagttgttcatcca

SEQ ID NO: 23866 - DNA, 961 bp, Homo sapiens
gtatcatttatcactgtgatcttaccaaagaggagctggagccaagagttttccgagaggtgaccgtaaaaggaattgatgcttctgattaccagacagtccagctccccaagggtactgagtcttccagaaactgaatcactggttgattgatgatgacgaagaatgtctctgttcctttgcaatgagaggtcaccaatagggcaccaggtgtttatcaaggcccctcccacctggagggctggaccacacaggccacagattaggaatcagaacattgtttgtgaaggaagatgagaataaagagcgctggatgttccccacaatgtttctgtgaaactagggcattattatagcttggtgaattacccttcaattgtctagaaatggtctagatgataggctacatctagatcatgaataaagctttgtttactaaaacaggtggtgggctggatttggtgtagagctatgatttatcagcccctgttctacatcagcagttggcaaactggcctcctgttttattggagaacacatgcccatttgtttacatattgcctgtggttgctttggcacttagagtggttgcaacagaaactctatgtcccagaaggcctgaaatatttaatatatggcctttaagaaaaagtttgcagaatcttcatctatgtaaatagcatttaaaagtacaacattcttgatagacatacagggccgagaagacatacagggtcaagaagctctgtcagacaggcctgaaatccacgtggggcaagtcatttaacctttctgccacagttttttcaactgtaaagtagagattgatagtatctgttttttaggattcctgtgggattattaagagataaggtatattcaagatctggcaatagaatataatctatttttttcaatcaacgttagaaataaatgtaacagacttttagtttcctattta

SEQ ID NO: 23867 - DNA, 332 bp, Homo sapiens
ggatagcttgtgtcaggtccaacttcttggtcttatgctacctccatgacgtcaagaacattctgcagctccatgacctgactactggtgctctccttaagaccttcccgctcgatgtcggcagcattgtagggtacagcggtcagaagaaggacactgaaatcttctatcagtttacttcctttttatctccaggtatcatttatcactgtgatcttaccaaagaggagctggagccaagagttttccgagaggtgaccgtaaaaggaattgatgcttctgattaccagacagtccagctccccaagggtactgagtcttccagaaactga

SEQ ID NO: 23868 - DNA, 3672 bp, Homo sapiens
gaagaaactgaggcccggagacacagttaagtgtaggagctaagacctcaacccaggtctctctgactcttaactacttattagcaatcaaggttaataaaagctacctcctgacaaaccagagatggccttacattttatttgtgcatcttgcaggggttttttgttgtttttaattaaagcgctaaatacctttttaacattaaaaatccgaagttgagtatgtccagtatttggaaccgaaccaaattggattttttgctatacagcttactgtacaagtgacctggaacagttgcttagaacctcccacagccacagtttggcaacctgtaaaatgtgcatggtaatatctactttattaagtccatataaaatttaaattagacaaacaagataaaagcacctggcagttagttaacactcaacaataattaatcttccctcccccacctttattaaataattaggcttttccagtttatcttccacatatataccaaagatacgttcataattatgtaagaccaaagggctttttaccttttacagccctgagttcctgagataccccattaagtctgtgtacttatttgcaaatttatattttgtttcttgttttgttttttgttttagtttaacccctatgtgtgccagagtcagtgctgcatagtttgagcctgataggattaactttacaaatgagacatttaagtcacatctgccaagaattatgatttgaatgaaactttaacttacacaggtttttagatttagttagcctaagttatcagctgtctgaagttattcataacctaagtggggcatggccctgaaaaggagggatgagaactgctgatcttagttactctgagaacccactactctgtaatcatacctataaaatcattcgtgtgctggcagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccat

SEQ ID NO: 23869 - DNA, 2315 bp, Homo sapiens
cccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctcca

SEQ ID NO: 23870 - DNA, 2308 bp, Homo sapiens
cccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcct

SEQ ID NO: 23871 - DNA, 3030 bp, Homo sapiens
attcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctggccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccat

SEQ ID NO: 23872 - DNA, 5212 bp, Homo sapiens
gcagacttcggctggacttgcctgcggtgacacctgctcccctctgagagcttcaggttctccggcctgccttcactggtttgtgtccagagccggactgattctctcaatttgctttaacccctatgtgtgccagagtcagtgctgcatagtttgagcctgataggattaactttacaaatgagacatttaagtcacatctgccaagaattatgatttgaatgaaactttaacttacacaggtttttagatttagttagcctaagttatcagctgtctgaagttattcataacctaagtggggcatggccctgaaaaggagggatgagaactgctgatcttagttactctgagaacccactactctgtaatcatacctataaaatcattcgtgtgctggcagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcgtagtcatgatttttggtggaatgttttatcaatttttgaaaattgcctttgtctcatataatgcttttcatattgaactatattttgtctgctattaaatacttccaagcc

SEQ ID NO: 23873 - DNA, 3080 bp, Homo sapiens
cattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaa

SEQ ID NO: 23874 - DNA, 5657 bp, Homo sapiens
gaagaaactgaggcccggagacacagttaagtgtaggagctaagacctcaacccaggtctctctgactcttaactacttattagcaatcaaggttaataaaagctacctcctgacaaaccagagatggccttacattttatttgtgcatcttgcaggggttttttgttgtttttaattaaagcgctaaatacctttttaacattaaaaatccgaagttgagtatgtccagtatttggaaccgaaccaaattggattttttgctatacagcttactgtacaagtgacctggaacagttgcttagaacctcccacagccacagtttggcaacctgtaaaatgtgcatggtaatatctactttattaagtccatataaaatttaaattagacaaacaagataaaagcacctggcagttagttaacactcaacaataattaatcttccctcccccacctttattaaataattaggcttttccagtttatcttccacatatataccaaagatacgttcataattatgtaagaccaaagggctttttaccttttacagccctgagttcctgagataccccattaagtctgtgtacttatttgcaaatttatattttgtttcttgttttgttttttgttttagtttaacccctatgtgtgccagagtcagtgctgcatagtttgagcctgataggattaactttacaaatgagacatttaagtcacatctgccaagaattatgatttgaatgaaactttaacttacacaggtttttagatttagttagcctaagttatcagctgtctgaagttattcataacctaagtggggcatggccctgaaaaggagggatgagaactgctgatcttagttactctgagaacccactactctgtaatcatacctataaaatcattcgtgtgctggcagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccgtacgttctggacaagcccctggatcaatttttcagcacactaattagcacttatgttctattttatttcattgtttgacagtcttttatacttctgagagatctaatcacttcttgaaagaatgtcaaggagctccattaaacagcaatctactgggggtattt

SEQ ID NO: 23875 - DNA, 6273 bp, Homo sapiens
gaagaaactgaggcccggagacacagttaagtgtaggagctaagacctcaacccaggtctctctgactcttaactacttattagcaatcaaggttaataaaagctacctcctgacaaaccagagatggccttacattttatttgtgcatcttgcaggggttttttgttgtttttaattaaagcgctaaatacctttttaacattaaaaatccgaagttgagtatgtccagtatttggaaccgaaccaaattggattttttgctatacagcttactgtacaagtgacctggaacagttgcttagaacctcccacagccacagtttggcaacctgtaaaatgtgcatggtaatatctactttattaagtccatataaaatttaaattagacaaacaagataaaagcacctggcagttagttaacactcaacaataattaatcttccctcccccacctttattaaataattaggcttttccagtttatcttccacatatataccaaagatacgttcataattatgtaagaccaaagggctttttaccttttacagccctgagttcctgagataccccattaagtctgtgtacttatttgcaaatttatattttgtttcttgttttgttttttgttttagtttaacccctatgtgtgccagagtcagtgctgcatagtttgagcctgataggattaactttacaaatgagacatttaagtcacatctgccaagaattatgatttgaatgaaactttaacttacacaggtttttagatttagttagcctaagttatcagctgtctgaagttattcataacctaagtggggcatggccctgaaaaggagggatgagaactgctgatcttagttactctgagaacccactactctgtaatcatacctataaaatcattcgtgtgctggcagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggccaggcaaggtggctcaggcccgtaatcctagcactttgggaggcaaggcagacagatcaccagaggtcaggagttcaagaccagcctggccaacatggtgaaacaccatctctactaaaaaatacagaaattacccgggcataatgacgtgcacctgtaatcccagctacttgggaggctgcagcaggagaatcacttgaacccaggaagcagaggctgcagtgtgccgagatcacgccactgcactcgagcatgggtgacggagcaagactgtctcaaaaaaaaaaaaaaacagtgttgagatcctttaagtattattgtgcacatgtgcaaatatttctaagtattaggaatggaattattaggtcaaaagataacttcattttttgtgtttatagctatagctgggttgcaagctttctattatttgcttgctatatcttcattttaattctttgtgttttatgttagtgtttcttatgtctgtttttgttatctgagtggttttatcttttaataggctaatttaacccattcatatttgtaattattgtattatttagacataattcggaagccctattttatttgtagttatactattgtttagggtttttttctattaagctttttgttggattgactgtataatttttttcttctagtattctttgaaaatttgaaaattgttatattttatgtctagtgttctttgaaaataattctttgaaaattatttttatgtcctaattttaccattaaaattatgaccacttga

SEQ ID NO: 23876 - DNA, 660 bp, Homo sapiens
cagacttcggctggacttgcctgcggtgacacctgctcccctctgagagcttcaggttctccggcctgccttcactggtttgtgtccagagccggactgattctctcaatttgcatgaagaaactgaggcccggagacacagttaagtgtaggagctaagacctcaacccagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaactt

SEQ ID NO: 23877 - DNA, 6049 bp, Homo sapiens
atttccggtactcgcatctccttggcaaccagggccgagctgtcacgccattgcaccattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcgtagtcatgatttttggtggaatgttttatcaatttttgaaaattgcctttgtctcatataatgcttttcatattgaactatattttgtctgctattaaatacttccaagcctgatttttgtaattttattttttattcaattacaagaatacatactataaaaaggttttcttcaacacctttccatagcttcacagttcccctcagagacaggcactatatgttcttttgtttttaatgtatcatatgtttgcataggcacagaatgtatcatttcatatgtttatatatttttctttacacagttggtgatatgttaccattctatactttattgaatacctgtttgaaatggtctcatatcaatgtatatagaactgtcatttttaaaagctgcatactgggcccatagttgatagaactggttttctgttgataaaatatttaaatcatttcttgtgtcttctattaaaaacaaattttgcaggccaggcaaggtggctcaggcccgtaatcctagcactttgggaggcaaggcagacagatcaccagaggtcaggagttcaagaccagcctggccaacatggtgaaacaccatctctactaaaaaatacagaaattacccgggcataatgacgtgcacctgtaatcccagctacttgggaggctgcagcaggagaatcacttgaacccaggaagcagaggctgcagtgtgccgagatcacgccactgcactcgagcatgggtgacggagcaagactgtctcaaaaaaaaaaaaaaacagtgttgagatcctttaagtattattgtgcacatgtgcaaatatttctaagtattaggaatggaattattaggtcaaaagataacttcattttttgtgtttatagctatagctgggttgcaagctttctattatttgcttgctatatcttcattttaattctttgtgttttatgttagtgtttcttatgtctgtttttgttatctgagtggttttatcttttaataggctaatttaacccattcatatttgtaattattgtattatttagacataattcggaagccctattttatttgtagttatactattgtttagggtttttttctattaagctttttgttggattgactgtataatttttttcttctagtattctttgaaaatttgaaaattgttatattttatgtctagtgttctttgaaaataattctttgaaaattatttttatgtcctaattttaccattaaaattatgaccacttg

SEQ ID NO: 23878 - DNA, 3090 bp, Homo sapiens
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggaccttatacctgtgtgttgcttctgaagctcacttcaactccggctgatggaaatgctgtgtgcactgggcttagctgtttttggaaagtcctttaattttttctcttccacttggcagcttttcttagttctgggatgttggccactgtggtactgccagtaagaaatctggcctttttctgctccatttctctttgtttctaaggtcagttttaatttgtttgaattctgccagtttaggaaaatgactctgttttgtctttttaaatctgagcaagctttatgctgtagtcactaattatatttcagtaagaagcctttaaaaattgatgaatcagctattccaaaagtagaatatagtaatattcagcttttaaatttttaaaattttattttctgatagttgttactgctgtcattaaaaccagaagtgttagacactaacaggcaggtgcacaagaacttttctgtatgacttccaaaagacaagctgactaattcatgcaggcagcatatttgacattaataaatggccaagccattcctatttccaaggggttggcttctttcaagcagttcttacactgagacctttcttcagagagcttttctaggataacaaatagggttggatcaaaacctttcagggacacagagagacagagagagagagactaacagtttctactctgttgaaagatttcttcctccttgtttcttttcattttctctcaataatttttttttcttcaccctgccttgggaacattttctgcttttaaaaaactgtaccttgagcttgatcatttttatggcattttttttttttaagggcatatatagagttcattcttgggatggaaagctgaa

SEQ ID NO: 23879 - DNA, 2120 bp, Homo sapiens
acccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggcccttgctgctgggcagttgcacatatgtattatccaactaaatcattacaagactcctctggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctt

SEQ ID NO: 23880 - DNA, 1397 bp, Homo sapiens
gattactcagagccaatcagaagaaggcgccgcagagggtggagcttagcgaggaaatcctacaagcatctggaaacgaccattttcgtcaaactgcgggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggcc

SEQ ID NO: 23881 - DNA, 2347 bp, Homo sapiens
gcgcgctggcccggcacggcggtggtcttgcgggaggcgtgggctgggattgcggtgcctgtgcttcccggtgccagggtgtcatggaagggctgctgacaagatgcagagcattgcccgccctggccacctgcagccgccagctctctgggtatgttccttgcaggtttcaccactgtgccccaagaagagggcggcgcctgctgctgtctcgtgtgttccagccacagaaccttcgggaagaccgggtgctctccctgcaggacaaatctgatgacctgacctgtaagagccagcggctgatgctgcaggtgggcctgatctacccagcaagccccggctgttaccacctcctgccatataccgtccgtgccatggagaagctcgtgcgagtgatagaccaggagatgcaggccatcgggggccagaaagtcaacatgcccagcctcagcccggcagagctctggcaagccaccaaccggtgggacttgatgggcaaagagctgctaagacttagagacaggcatggcaaggaatactgcttaggaccaactcacgaggaagccattacggccttaattgcctcccagaagaaactgtcctacaagcagcttcccttcctgctgtaccaagtgacaaggaagtttcgggatgagcccaggccccgctttggtcttctccgtggccgagagttttacatgaaggatatgtacacctttgactcctccccagaggctgcccagcagacctacagcctggtgtgtgatgcctactgcagcctgttcaacaagctagggctgccatttgtcaaggtccaggccgatgtgggcaccatcgggggcacagtgtctcatgagttccagctcccagtggatattggagaggaccggcttgccatctgtccccgctgcagcttctcagccaacatggagacactagacttgtcacaaatgaactgccctgcttgccagggcccattgactaaaaccaaaggcattgaggtggggcacacattttacctgggtaccaagtactcatccattttcaatgcccagtttaccaatgtctgtggcaaaccaaccctggctgaaatggggtgctatggcttgggtgtgacacggatcttggctgctgccattgaagtcctctctacagaagactgtgtccgctggcccagcctactggccccttaccaagcctgcctcatcccccctaagaagggcagtaaggagcaggcggcctccgagctcatagggcagctgtacgaccacatcacagaggcagtgcctcagcttcacggggaggtgctcctggacgacaggacccatctgaccatcggaaacagactgaaagatgccaacaagtttggctacccctttgtgataatcgctggcaagagggccctggaggaccctgcacattttgaggtttggtgtcagaacactggtgaggtggccttcctcaccaaagatggagtcatggatttactgaccccagtgcagactgtctaaatgcccccagcccacccctgcccccatttgcagccttggtgttcgttctaacactgcattttcctacacccctttcctggactgctctctccagaaacagcacagctcatggagggtgagatcatgttagggaaatcaatttttatctagtcatttgttcagattatttgtatttaaagtcattaacttgatccctttctccagactggccatgccgccatatacctttccttttgtattccattgtggaagcttctaggaggctgagaagcaggagatccaagctccagtcctgggtgttaccctgaggggggaagtcacttcccttctctcagctgagtttttcacgtgtaagatgagaatggctgatggctgagagcccaccaaccttccccaccccgtatcagtttgaccacgggccttttgctacattctatccagagagcaggcctgccagcccctctccactgagaagttgggctgagagtatggggaaaagaatcaagagacctgactgccgccaactcactagtgacttagatacatcccctccccctgctggggcctcagtttccccatctgtaacttgagaaaatagaactagatctgtaaagtctggaactagatctgtaacgtccttataggtgtcactagggggttccatgagaggtgtgtgacaggcagtctgattcctctcattctccatagtctgtttcctggaaagtcgatgtaattaactgatggcccaaaaactacctcaagagacctggccctgttaagacggcttaaccactgagatcccgttctattgatttaataaagtcaaactattggaa

SEQ ID NO: 23882 - DNA, 766 bp, Homo sapiens
cgtttaccaagcaggctgacagagaaatttttcattttctttcttgtttgactgtatgcaaacatcaaactaagaatggcaaaaatgaatctctcttcctatatattaatactaactttttctttgttttctcaaggtattttactttcagcatccaagtccataagaaatttagatgatgacatggtatttaatacattcaggttggggaaaggctttcagaaggaagacactgcagaaaaatcagttattgctccttccctggaacaatataaaaatgatgagagcagtttcatgaacgaagaggaaaataaagtttcaaagaacacaggctccaaacataatttcttaaatcatggtctgccactgaatctggctataaaaccttatcttgcactaaaaggatctgtagctttcccagctgagaatggagttcagaatactgaatcaacacaagaaaagagagaaattggggatgaagaaaactcagctaaatttcctataggaaggagagattttgacatgctcagatgtatgctgggaagagtctaccgaccttgttggcaagtctgatacctgttggtccacatcatcttttcagaagaaaataaaagcatttaattgccaatgggaggagaagcccatactgctactataacttgtgtatgttaaatgtctgttttaaaagaaagtagtgttaagatgtatcagtaactgaaatgatatgctttctctgtgcattaaactttgtgaaaattctgcataa

SEQ ID NO: 23883 - DNA, 3977 bp, Homo sapiens
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 23884 - DNA, 4349 bp, Homo sapiens
ctgctgcacactaaggatccaaatgattgtttttttgttttttgttttgttttgttttgttttgttttgttttaaattgcattgggattaggcaacagaagggtctaatgcggccgggatgagacaggagagtttttaggagggtagctgcattctaagtaagggactctgcggggggaaaagaggcgcaagcgttgcaagaagggagtgcagggggttgagcaggcacctctacaggaaatggatgctgtccaggtgctggtgggcgccccagggctacgtggcgaagcagctcagccggtccaatcagagtgcgtccagggctcgggtttcgcgatctttaagtgactgaggcagatccccacgcggcacctggccatgctctcagctctcccgccgcgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaaca

SEQ ID NO: 23885 - DNA, 4014 bp, Homo sapiens
ggcgagctaagggaagggcggcggcagcggtgactagggcgggagcaggagcgggagccgggtgcacgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaa

SEQ ID NO: 23886 - DNA, 551 bp, Homo sapiens
agaggaactgcggggagagcgtggtggtgccggtgcccgtccaacccaaactttttagtctgagtggtggcccgcgacgccccgcttgggtcttctttccatccactggggatgggggcgggggtgggggtagccggcggccgtggttccggagcgggagtcggagggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaact

SEQ ID NO: 23887 - DNA, 567 bp, Homo sapiens
agaggaactgcggggagagcgtggtggtgccggtgcccgtccaacccaaactttttagtctgagtggtggcccgcgacgccccgcttgggtcttctttccatccactggggatgggggcgggggtgggggtagccggcggccgtggttccggagcgggagtcggaggtgagtgtgcgaactggaccggggccccagagacttcggactcgctctcggggagaacggtgaccgagggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaatt

SEQ ID NO: 23888 - DNA, 4006 bp, Homo sapiens
gactagggcgggagcaggagcgggagccgggtgcacgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttgg

SEQ ID NO: 23889 - DNA, 568 bp, Homo sapiens
attcttttgtgtcccgcagctcgcgagaggcttccgcccagaagggagctaggcctggagggggcttggcctggaggtggtttggagggagggcactgaagggacagtgtcttgatgtcatagttagatcttggactttgaaggcaaactagtgggtttgactcttggccacatggttaatcacctgtgaccttgggcaagtcaccagaatcctctctgtgtcagtttcctcatctgcaaaatggaataatgccttaaacaaggaggaccttgtttctatctatgaagcatggagaacagtgcctggaagataggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcg

SEQ ID NO: 23890 - DNA, 3884 bp, Homo sapiens
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgacccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 23891 - DNA, 3908 bp, Homo sapiens
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaacccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 23892 - DNA, 2773 bp, Homo sapiens
gcgatctttaagtgactgaggcagatccccacgcggcacctggccatgctctcagctctcccgccgcgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatagtagttgggtcacttctgttcagtgttga

SEQ ID NO: 23893 - DNA, 1464 bp, Homo sapiens
gcatcccggtggggagaagggccaggcagagaaaagtagtcagaaacagagcaacaggtgaggctgaggcaggagattgagctgacactcaagccaaggaagggggaattaggaaacaattagaaaaaaagtaaagacagtgaaaaagtcagagacagctgcctgcacctacacacacattcagagacagagtcccagagggtggcatacacagagggagaaggggagggaacaggtgtggagaggagctgcggaagcagagaaatctcaagtcagagattcagggacacttggtccccgtggcgagccatggaagcagaaaggaggcgccaggctgagaagccaaagaaggggcgagtcggcagcaacctgttgcctgagagacacccggccactgggaccccgaccaccacggtggactcgagtgctccaccctgcagaaggctccctggtgcaggaggggggagatcaaggttctccccgcaaggaggacagaggggccgcccgcactcccggcgccgccaccgcaccaccttcagcccagtgcagttggaacagctggagtcagcctttgggaggaaccagtaccccgacatctgggcccgagagagtcttgcccgggacactggcctcagtgaggcccgaatccaggtctggttccagaaccgcagagctaagcaacggaagcaagagcgctcactgcttcagcctctggcccatctgtctcctgccgccttttccagcttcttgccagagtccactgcttgcccctattcttacgcagcaccaccaccaccagtgacctgcttccctcacccctacagccatgccctcccttcccagccctccacaggaggcgcctttgctttgtcacaccagtctgaggactggtaccctaccttgcacccagcccctgccggccatctgccctgccccccaccccctcccatgctccccctcagccttgagccatccaagtcctggaactgaggtcaaacaagtaccaccaaggtgatccccagcctgcggccctcgtgaaaagacaagaaaatggggtggcttcctttccatctatgggtgaagcagatgcatggtgagggtcagctcagcgattagaaatttaaaaatgggagatcatggtgaattctcactggggtgattagtggaggaagtctggggaggtgagctactggaagagacagggcaagatgcctcggtggagctgcctgctgaagggtgatattgatgaagacagttgctggtgagtggagatgattgaagggctaggaggtgagggccttcattaattgagatcacgattgaagaagatcccagctctttctggctgatttcagtaaggcttctgacttaagagtctacctatacatcccttccccattgcccaccccgccatctcaatcagtcactgacttttgtttattctgtcctagaaatacctttttt

SEQ ID NO: 23894 - DNA, 1226 bp, Homo sapiens
aacatcagtttatgtcctgaaatatgttttcagaaaatagaaagccaagtatatttcgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 23895 - DNA, 2507 bp, Homo sapiens
acaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggcaacctcgagtctgtctgtagagatctgcctattctggacatttcaggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 23896 - DNA, 2418 bp, Homo sapiens
ggcatcgggtttctggctcgtgatttgccggagctcctgcgctccccttctccaccccctccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 23897 - DNA, 2491 bp, Homo sapiens
gtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 23898 - DNA, 2481 bp, Homo sapiens
ggcatcgggtttctggctcgtgatttgccggagctcctgcgctccccttctccaccccctccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 23899 - DNA, 397 bp, Homo sapiens
caactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgccctggagaaagcttctggattgactgtgagaagcttggcagaaggtgctgcggcctggtggctggctcagcaggaggcctgggattgaaagctctcggtttgtacaagctcttttggatttgtaacacttttattttaaatctccaataaatgtaaatattttggtc

SEQ ID NO: 23900 - DNA, 602 bp, Homo sapiens
tacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggcaacctcgagtctgtctgtagagatctgcctattctggacatttcaggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 23901 - DNA, 669 bp, Homo sapiens
aatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 23902 - DNA, 939 bp, Homo sapiens
tccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctgttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 23903 - DNA, 1833 bp, Homo sapiens
agcgccgtacccacgctttagcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatc

SEQ ID NO: 23904 - DNA, 1841 bp, Homo sapiens
gcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcagcaaataataggctgggcacagtggctcccgcttgtcatctcagcactttgggaggccgaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatct

SEQ ID NO: 23905 - DNA, 6090 bp, Homo sapiens
cgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtaagagtccaagaagtgtttcaccaggttgtgcagtctggacaccgagatggtagaggggctgtaagatggtagaggaaccagctcaggagagcagctgggctagcagctttacggaagccttggatggtggggaaactcccgtacagaaactcagctggtcaaagaaactcaaagccacaagaccttggaagctttgtcaagtggaccagcctccatggaccacggaataccttgagagtaatgacagttgagtgttctcttgtgtgggaatgccttccccagctggtgccctcaccttaaagggaaaaagaaaatacactgaattttgtaaatgggaaatacttgggtccactgagctgatagctgacaagtgtctgtctttaaactgagagcagataatatggtgagctgtggtgtaggaagcactgctagggtcttgctggtcctgccccgccttgtgttaatccagttcctcctgagctacacagctgacaagtggtgaagctgggatttgaactcagatgggtttgaccccagccaagcctgtgttctgatcatttcaaagtactaccactcagctgatgaggaaggtgagatggacttctaagggttggcctaagagtaggggtgagggaggttggtggtctgttcccctgggcttgtcttaacccagaaagctactacatttagacagctttcctatctcccgcatgattctcttgcaaagcagtaccaacagatggccagtcatctttttgagttgctagagtaatggggagcacatccacaatacacccttctaatgcttgttagaaagtgcttttgttgcaaagttcttctagcttctttttttgaccctgtcttggtctccccagcccaactttctgcctctggttgcactgatactttgtcctggtgctggtgcttaagatgtggtctgctcagccaaagaagtctgtgaaggatactcacccacatgtggagttgatgaatcagccctcttcacctattcaacagatgtgactgttttgtctttctggttccaaaggatttctggagagctatgactttacccttttagaagtattggtcctcatactctgtgcacctctgatgtcagcatgggatttctacaattccaagcaggagttgcagccacttgataggcagtgcctcagtctggggcctctgtggaatccagctggcatattccagccaatgtggcagcctcaatagttagttaagttttgaccatgtccctactgtcctgggtggtgaaaatactccctttatgtgtccttgggagcagaaagatgctcttcaaaaagtggtgcctgatggagatctccacagaacaagacactcagaagggcagggatagaatcttacctgagcttggtctagtatgaaaagcctaaggctgggtgcgatggcccatgccctgtaatcccagcactttgggaggccaaggcaggtggattgcttgagctcagttcatgaccggcctgggcaacatggtgaaagcctgtctctactaaaaatacaaaacttagctgggcgtggtggtgggtgcctgtaattccagctacttgagagcctgaggcaggagaatctcttgaaccccagaggcggaggttgctgtgagctgagatcacaccattgtactccagcctgggtgacagaccgagaccctgtcttcacttaccgccccccccccccccccgaaaaaaaaaaggcaagcctgagtggcatcaaacctttgtttcccatgaatatactagtccctgcttgatggactgttacctgggaacaggggcaaacagggagttacagtcaagccacaaatgggagatttgcaagcctgacccaagcctgaaagtgctcatctagtctcatactcttgtaaccatctagatgagctgttacagaccatccttaaatgaccttccttccttggctgtctggaaagcttgcttgctgatttgtctcccacacctttgccttttttgcataggcatattaggccatttaaggaactcaccccctattgccagacccatgaagtgtgtagggtatgacttcttaaagaaagagtgaggaggtctaatgccaagagaaactttttaagacagtctggctctgttacctagattggagtgcagtagtggtgcaatcttggctcactgcaacaacctccaccttgtgggctcaagccatcctcctaccttagcctcacgagtagctggtgtgcgccatcatacgcagctaatttttgtattttttgtagaggagttttaccatgctacccaggctggtctcgaactcttgagctcaagtgatccactcaccttggccttccaaagtgctgggattacaggcgtgagccaccatgcctggctgaaaacttcatttctgtagctgcattgactctatgtggtcttcaaaagggcactgccagggtgcaattatgcatgtaagcccagagtctcaagccgtgaggacccatgctacaggccagtggatgggtgttccctgaatgcctcatgcaaaactcagtttgcaagagactccctcttaaaccacagatgacttggcctacacacactccagagaaatctaaggaatgaaagaaagtgagctattcctaaattctgctttcttaaaaaaaattaaaaagccaaaacaacaaaaccaccaactcactaataaggttaacttgctgccatttaacagattatcagaaattgcaaactctctcaagagccacaggacagaaaatcatctctttaaagccatacctggtagaaacaataggatgactaccacaagcctgattttgaatagtttattaaaggaaaggtgaagcatcagtttcaaattgtacaaaaggaaaaaaaacctcatattgcaaatgtacaatttacagaattactagcaaaaccaatcaaggagacaccgaaaatacaaaaatttgattgacttcaaactgaactggaaacccattggagtagatatttagcctttttgtgtggcatggtagtctacaattctgtcagcatctgttttccatacaagactgtcacgcaaaggatcaatttgtgcatgtgccagggcacctcatggcttgctccctggccaaaaccacaggcaggcagggctggggtggacagtccagtcattcctgcaccttcacttccagtgaagcccacaattctgggagaaagtgaggccccagctcccctaactggagcccaagaattgctgaattagcagagaagatatttttggtgaccaggtttttttcagaactgtacaaatgttgagaaaaatgttttgtgtctttactaaaaggatgaataaaatcatccatcatcatcttgctttcccgcacaaaagatgatcactgggtgtgcagaattttaaaaaatgtttttcgtatttgataaaaagggaaagcctcatgattctgttgcagctactttaaaaaccagcccagaaacagctgtggatgaattggtttggaaattctgaggcttactttagaaatcagaaaggaagagagagactaagtggggtttttaaaacaatagcagcaagtcataaaagtctaggcagaatgtaactctaaaccattgtagactgtcctgaagattcataatttctttccccaaaagaattattcttaatatgcacatttaacactgaaatgtagctgtaattcaaggtaagcttaggaacttcaccctctaagcacagacttctatgcagcacatacttctataatcagtaaacttaattcacaaaattagcgcataagggtattaagtgcatgggaagtaaacacagttatgttacacttaaaattacttttgaatgattgataaaggatttcttcatgattgattatcttaagaaaatggaagtctgtgtaacttgaatttggcagggcatgaaataagtggtaaaaacagcaaactgataacttgagaatcattttcgttttactgagaatactttatttgctggtagaagttgctaaaaatgcacagaacaaataccaatagaaaatgcactgtatttgaatctccctagtctatataaaatgaacggtgtacagcatctgttggaaaaatggctgcatggacatttcttattttatgcccacttataaataaaaataaaccttttattcaagagtatataaaatctgggaattcatatccatatccacagagggtgtgtggtttttggcagagatgtactatgtcagaatttcatcttagcttgtcaatgttctgctccttcattatttgtgttccacaaaggtcaaccaaatccagtgaactccaaaacactcttcgcaattaggatgagctgcttactcataggtttaataaaaatggttagcttttaaaacataaaaaggcaaaatgttaaaacggtttttaaattgtacaacaggaaaataaagttaaaaatatgttttttttt

SEQ ID NO: 23906 - DNA, 715 bp, Homo sapiens
agaagccacttatctgcagacttgtaggcagcaactcaccctcactcagaggtcttctggttctggaaacaactctagctcagccttctccaccatgagcctcagacttgataccaccccttcctgtaacagtgcgagaccacttcatgccttgcaggtgctgctgcttctgtcattgctgctgactgctctggcttcctccaccaaaggacaaactaagagaaacttggcgaaaggcaaagaggaaagtctagacagtgacttgtatgctgaactccgctgcatgtgtataaagacaacctctggaattcatcccaaaaacatccaaagtttggaagtgatcgggaaaggaacccattgcaaccaagtcgaagtgatagccacactgaaggatgggaggaaaatctgcctggacccagatgctcccagaatcaagaaaattgtacagaaaaaattggcaggtgatgaatctgctgattaatttgttctgtttctgccaaacttctttaactcccaggaagggtagaattttgaaaccttgattttctagagttctcatttattcaggatacctattcttactgtattaaaatttggatatgtgtttcattctgtctcaaaaatcacattttattctgagaaggttggttaaaagatggcagaaagaagatgaaaataaataagcctggtttcaaccctctaattcttgcctaaa

SEQ ID NO: 23907 - DNA, 5086 bp, Homo sapiens
tttccattctggctgggaagggctggggctccactcagcctggagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaattgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaat

SEQ ID NO: 23908 - DNA, 565 bp, Homo sapiens
ttttatgggaaagtaatggcacagctccagctcagcaccaaagtgaagagctctactgaggcacaatggaaagtcgagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacggg

SEQ ID NO: 23909 - DNA, 2234 bp, Homo sapiens
cggccagtcccactgcagggtcgagatgccgaactgactatggggaagggatctatttctttcttgttcttcagccaaattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaattgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtg

SEQ ID NO: 23910 - DNA, 1050 bp, Homo sapiens
ggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctcgcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 23911 - DNA, 4740 bp, Homo sapiens
gaggaggagctgaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaagcttccctttgctgaaggtctgtaccacttttatcacaatggccttgcaaaggccaagagaagacgcagcctacaccacaagcagcagctggagagagaccccagggtaaagatggctttgcagcaggaaggatttgaccgaaaaaagcgaggttacagagacatcaatgagatcgacatcaacatgaacgatcctctttttacaaagcagtggtatctgatcaatactgggcaagctgatggcactcctggccttgatttgaatgtggctgaagcctgggagctgggatacacagggaaaggtgttaccattggaattatggatgatgggattgactatctccacccggacctggcctccaactataatgccgaagcaagttacgacttcagcagcaacgacccctatccttaccctcggtacacagatgactggtttaacagccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaaaagagaaaaaaaattaagacaagcctggcaacacacctggtgaagagtagtttactagcttttcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcattaatgtgttgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaaggttatggtcaatcccaaaagtcaccactccattcccaactagacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatgattctggctgaaaaaggccagtggaaattcaggtgaaaatgttcatcaattcccattgcatcacctctgtaatttttcagctctctgtataaacattaaatgtcttatatagcagcaaaaatataaaatagttgtccatattttcacaggtgtggtgtaatttataaaattagaaagcaacttatcagctacttaagagaaatggcaagttttgatatgagtatacaatatataaaaatatatatagtgctatatatataaatatttggtctctatttcattttttgcatcagtattaatactaaaatatgtctcgctagtgatgtttttatgatatccctgatcctaactgaagagacagttatttatagtcatttattttaaaaaatgaaaataagtgaataataattaggttaacattgttgctccctgtgacaaaattttataagcaaatttcaaaagacatgttgtaaattaggaggctcaacaataaaacattatgctccagaaa

SEQ ID NO: 23912 - DNA, 4674 bp, Homo sapiens
aactagcaccctcgctgtccttgtgcagtggaacgtccccaggtctgagaatgcacctcccgccgtgtccaccccggccgcgtctctcctgaaggcagatcttggaggtgcagccaggactcctagaggagcctcctccagtcaccatcgcgggtggggcgagccgggtctcctgctgggcttcccagccgcttcgctccggacctgcctggagcctacaaaaaacaagggctcgtccttgcactctcgccccccatggatcacccctagaagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaagcttccctttgctgaaggtctgtaccacttttatcacaatggccttgcaaaggccaagagaagacgcagcctacaccacaagcagcagctggagagagaccccagggtaaagatggctttgcagcaggaaggatttgaccgaaaaaagcgaggttacagagacatcaatgagatcgacatcaacatgaacgatcctctttttacaaagcagtggtatctgatcaatactgggcaagctgatggcactcctggccttgatttgaatgtggctgaagcctgggagctgggatacacagggaaaggtgttaccattggaattatggatgatgggattgactatctccacccggacctggcctccaactataatgccgaagcaagttacgacttcagcagcaacgacccctatccttaccctcggtacacagatgactggtttaacagccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaaaagagaaaaaaaattaagacaagcctggcaacacacctggtgaagagtagtttactagcttttcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcattaatgtgttgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaaggttatggtcaatcccaaaagtcaccactccattcccaactagacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatgattctggctgaaaaaggccagtggaaattcaggtgaaaatgttcatcaattcccattgcatcacctctgtaatttttcagctctctgtataaacattaaatgtcttatatagcagcaaaaatataaaatagttgtccatattttcacaggtgtggtgtaatttataaaattagaaagcaacttatcagctacttaagagaaatggcaagttttgatatgagtatacaatatataaaaatatatatagtgctatatatataaatatttggtctctatttcattttttgcatcagtattaatactaaaatatgtctcgctagtgatgtttttatgatatccctgatcctaactgaagagacagttatttatagtcatttattttaaaaaatgaaaataagtgaataataattaggttaacattgttgctccctgtgacaaaattttataagcaaatttcaaaagacatgttgtaaattaggaggctcaacaataaaacattatgctccagaaa

SEQ ID NO: 23913 - DNA, 2275 bp, Homo sapiens
acacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaaggtaaagatggctttgcagcaggaaggatttgaccgaaaaaagcgaggttacagagacatcaatgagatcgacatcaacatgaacgatcctctttttacaaagcagtggtatctgatcaatactgggcaagctgatggcactcctggccttgatttgaatgtggctgaagcctgggagctgggatacacagggaaaggtgttaccattggaattatggatgatgggattgactatctccacccggacctggcctccaactataatgccgaagcaagttacgacttcagcagcaacgacccctatccttaccctcggtacacagatgactggtttaacagccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatc

SEQ ID NO: 23914 - DNA, 2661 bp, Homo sapiens
cccactcggcggtttggcgggagggaggggatttgcgcaggccccgctcccgccccgcctccatgcggcccgccccgattgcgctgtggctgcgcctggtcttggccctggcccttgtccgcccccgggctgtggggtgggccccggtccgagcccccatctatgtcagcagctgggccgtccaggtgtcccagggtaaccgggaggtcgagcgcctggcacgcaaattcggcttcgtcaacctggggccgatcttccctgacgggcagtactttcacctgcggcaccggggcgtggtccagcagtccctgaccccgcactggggccaccgcctgcacctgaagaaaaaccccaaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcacgggacccgctgtgctggggaggtggccgcgatggccaacaatggcttctgtggtgtgggggtcgctttcaacgcccgaatcggaggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaagggccgcggcgggctgggcacgctcttcatctgggcctcgggcaacggcggcctgcactacgacaactgcaactgcgacggctacaccaacagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatgatcgccctagcgctggaggccaacccgttcctgacgtggagagacatgcagcacctggtggtccgcgcgtccaagccggcgcacctgcaggccgaggactggaggaccaacggcgtggggcgccaagtgagccatcactacggatacgggctgctggacgccgggctgctggtggacaccgcccgcacctggctgcccacccagccgcagaggaagtgcgccgtccgggtccagagccgccccacccccatcctgccgctgatctacatcagggaaaacgtatcggcctgcgccggcctccacaactccatccgctcgctggagcacgtgcaggcgcagctgacgctgtcctacagccggcgcggagacctggagatctcgctcaccagccccatgggcacgcgctccacactcgtggccatacgacccttggacgtcagcactgaaggctacaacaactgggtcttcatgtccacccacttctgggatgagaacccacagggcgtgtggaccctgggcctagagaacaagggctactatttcaacacggggacgttgtaccgctacacgctgctgctctatgggacggccgaggacatgacagcgcggcctacaggcccccaggtgaccagcagcgcgtgtgtgcagcgggacacagaggggctgtgccaggcgtgtgacggccccgcctacatcctgggacagctctgcctggcctactgccccccgcggttcttcaaccacacaaggctggtgaccgctgggcctgggcacacggcggcgcccgcgctgagggtctgctccagctgccatgcctcctgctacacctgccgcggcggctccccgagggactgcacctcctgtcccccatcctccacgctggaccagcagcagggctcctgcatgggacccaccacccccgacagccgcccccggcttagagctgccgcctgtccccaccaccgctgcccagcctcggccatggtgctgagcctcctggccgtgaccctcggaggccccgtcctctgcggcatgtccatggacctcccactatacgcctggctctcccgtgccagggccacccccaccaaaccccaggtctggctgccagctggaacctgaagttgtcagctcagaaagcgaccttgcccccgcctgggtccctgacaggcactgctgccatgctgcctccccaggctggccccagaggagcgagcaccagcacccgacgcctggcctgccagggatgggccccgtggaaccccgaagcctggcgggagagagagagagagaagtctcctctgcattttgggtttgggcgggagtgggctggggggagaggctggagcaccccaaaagccaggggaaagtggagggagagaaacgtgacactgtccgcctcgggcaccgcgtccaacctcagagtttgcaaataaaggttgcttagaaggtg

SEQ ID NO: 23915 - DNA, 2641 bp, Homo sapiens
ggcccgccccgattgcgctgtggctgcgcctggtcttggccctggcccttgtccgcccccgggctgtggggtgggccccggtccgagcccccatctatgtcagcagctgggccgtccaggtgtcccagggtaaccgggaggtcgagcgcctggcacgcaaattcggcttcgtcaacctggggccggtgggtgggaccgggatagacgggaagtgggggcttggaggggactgaacaaccctagaccccgacaagggggagggagcccacaaggtcttctaaatatcaagagtcccagcccacccctgcctcagccaagctcagcttctgggactcccagagagcacctgctggggaaggacaaagaagggggctgttaccggccctcgggggcttcagcaggggagccgggtcccatcggtgcggccgcttccccacatccccagatcttccctgacgggcagtactttcacctgcggcaccggggcgtggtccagcagtccctgaccccgcactggggccaccgcctgcacctgaagaaaaaccccaaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaagggccgcggcgggctgggcacgctcttcatctgggcctcgggcaacggcggcctgcactacgacaactgcaactgcgacggctacaccaacagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatgatcgccctagcgctggaggccaacccgttcctgacgtggagagacatgcagcacctggtggtccgcgcgtccaagccggcgcacctgcaggccgaggactggaggaccaacggcgtggggcgccaagtgagccatcactacggatacgggctgctggacgccgggctgctggtggacaccgcccgcacctggctgcccacccagccgcagaggaagtgcgccgtccgggtccagagccgccccacccccatcctgccgctgatctacatcagggaaaacgtatcggcctgcgccggcctccacaactccatccgctcgctggagcacgtgcaggcgcagctgacgctgtcctacagccggcgcggagacctggagatctcgctcaccagccccatgggcacgcgctccacactcgtggccatacgggacgttgtaccgctacacgctgctgctctatgggacggccgaggacatgacagcgcggcctacaggcccccaggtgaccagcagcgcgtgtgtgcagcgggacacagaggggctgtgccaggcgtgtgacggccccgcctacatcctgggacagctctgcctggcctactgccccccgcggttcttcaaccacacaaggctggtgaccgctgggcctgggcacacggcggcgcccgcgctgagggtctgctccagctgccatgcctcctgctacacctgccgcggcggctccccgagggactgcacctcctgtcccccatcctccacgctggaccagcagcagggctcctgcatgggacccaccacccccgacagccgcccccggcttagagctgccgcctgtccccaccaccgctgcccagcctcggccatggtgctgagcctcctggccgtgaccctcggaggccccgtcctctgcggcatgtccatggacctcccactatacgcctggctctcccgtgccagggccacccccaccaaaccccaggtctggctgccagctggaacctgaagttgtcagctcagaaagcgaccttgcccccgcctgggtccctgacaggcactgctgccatgctgcctccccaggctggccccagaggagcgagcaccagcacccgacgcctggcctgccagggatgggccccgtggaaccccgaagcctggcgggagagagagagagagaagtctcctctgcattttgggtttgggcgggagtgggctggggggagaggctggagcaccccaaaagccaggggaaagtggagggagagaaacgtgacactgtccgcctcgggcaccgcgtccaacctcagagtttgcaaataaaggttgcttagaaggtg

SEQ ID NO: 23916 - DNA, 5756 bp, Homo sapiens
cggagggagcgctgggagcgagcaagcgagcgtttggagcccgggccagcagagggggcgcccggtcgctgcctgtaccgctcccgctggtcatctccgccgcgctcgggggccccgggaggagcgagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatgcaacggaagagtcctgggcggaaggaggcttctgtatgcttgtgaaaaagaacaatctgtgccaacggaaggttcttcaacaactttgctgcaaaacatgtacatttcaaggctgagcagccatcttagatttctttgttcctgtagacttatagattattccatattattaaaaagaaaaaagccaaaaagaaaaaaaaaaaaagcaagccacctctctctttcttttcttgctctctttttctttctctctctctcaagtttgtgcagggagatggtgaactgttttgtcagaacttaaatggaaaaaaaaataaaactacaacaagcctaccttttataactgggtgtttagtgctaaacagccagaaccacagagacagtattgtatgaccaaagcatttgatgccaaaatttgacgttaaagtaatgatttgatttcctgccctggttttgaaggtccatttttttcccttttgcattgacttgcttgtttcccctttgaaacacctaaaaatacctttccaaaacatcgcgagagcatacatagacaaaaatgaaatagaaagctcttgcatgcttgagtccaccattgggggaaatgacagaaaactggacctgagggcattaggaacatcctacagagttgtgtttagtgtcgtttgccatggtatttcacagtgaaacatggatactctccacacatcatttacttcatgctgtgtacttatgtactggtttttgcattttactcacttgataagtctgctccactggtttcatcagatagacttgctgctactggcttttccattgtagattgggttattttacacgcagttcgccaaatgggattgctctgtatagtcaaattggtgatggacagatggacagaatgcagaggtacatagatgagctgaggctgatccagctcccctgaaattcagagtgttaactttgtagaccctgcacaatctcttggtgctatctagccattacccccattttttttttaaaggccatctgaaattccatttgtcatggtgggaagcattttggatatgatgcaggaaatctcttcctggagtcaaaagttcccaagaggtcctgtatttttaagaaatggaatttatttaaataatatttaagcttgtgcccatgttggccgggcaacttttttcaatggtgcttattagaagaagttttttcatcttgtcattttaagaaaataaaactggaaattgaatatgggtggcatgattgtacccttttagttctcttatttttctactcctctgtccctctataactatgccatactattatatgctggtccactgaatgctgagatgatctgttttttggggttttttttttttaagaaatattttcactggttttctgtgactctctaaacacttcatcgaaactagaagactgaattatgaggaaactatttggattagtggccagaaacgatgaaatcttatagatcttttgacagtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactatcaacatggactatcctgggaaagagctaggaagtagatgctgaggtccccatccaaacagcaagctaggaaaaagcctgccttgaaaatatttctagacatcaaagataacttacaacccaaagtgaataataagtaaatagtctgatgaccctcttaatagcattgcaattgtattgaatcacataatgattcataagtaactagggaaccaactgattttgctaagcagtcttccccttataacaccacaggcccttctgacacacaaaaaaatgaaagttaatcctgggtacagcatacagttttacatttaaacgcacagtcttacgtggacaaatgcaagcacaagcctaaagcaaggtcaagcagatggcaaaaccgaatttgcctgcaaagaaatctatttaactgaatcagcccataatatttgaggcacgaggttactgtgattgataggaaagataaaaatgatgtctgtttttgtagacgaataaccatcaacatgacaacaaaattcattggggtctaccagcgtgcattccatttcccactgaccatgcaggtgcacgtcgcggaaatactggtttaactactagtgtgttactgcctcatttatctacataacattattaactagaacataatgctttcaaagtttaagttaatgttatatattatgtataaatatatatattcataatgagatatatgtaatggatagtacaaagtttggagactcaacaaatgctctaaccttctagagacaaaagtcctatttctgttttcttttgtctttttattttcaattagtgacccattgttaaatccaaatccacttttactgaaaaatactgtacatgtgtaaaatgttcagttgtttttttgtaaaatatagtagaacggttgtaactgatactggccaaaatcaatgttattccatattttattttttctattaaattaacctaagttcctgttta

SEQ ID NO: 23917 - DNA, 6202 bp, Homo sapiens
atttatgcagagcaggagctgctgccattgccactcagaatcctcgcgcgctgctcggagccggagggagcgctgggagcgagcaagcgagcgtttggagcccgggccagcagagggggcgcccggtcgctgcctgtaccgctcccgctggtcatctccgccgcgctcgggggccccgggaggagcgagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatggagaatatgttgatgagcatggccactgccagacctgtgaggcctcatgtgccaagtgccagggaccaacccaggaagactgcactacctgccccatgacaaggatttttgatgatggccgctgtgtttcgaactgcccctcatggaaatttgaatttgagaaccaatgccatccatgccaccacacctgccagagatgccaaggaagtggccctacccactgcacctcctgtggagcagacaactatggccgagagcacttcctgtaccagggagagtgtggagatagctgcccagagggccactatgccactgaggggaacacctgcctgccctgcccagacaactgtgagctttgccacagcgtgcatgtctgcacaagatgcatgaagggctacttcatagcgcccaccaaccacacatgccagaagttagagtgtggacaaggtgaagtccaagacccagactatgaagaatgtgtcccttgtgaagaaggatgtctgggatgcagcttggatgatccaggaacatgtacatcttgcgctatggggtattacaggtttgatcaccattgttataaaacctgtcctgagaagacctacagtgaggaagtggaatgcaaggcgtgtgatagtaactgtggcagctgtgaccagaatgggtgttactggtgtgaagagggcttctttctcttaggtggcagttgtgtgaggaaatgtggtcctggattctatggtgaccaagaaatgggagaatgtgagtcctgccaccgagcatgcgaaacctgcacaggccctggtcatgacgagtgcagcagctgccaggaaggactgcagctgctgcgtgggatgtgcgtgcatgccaccaagacccaggaggagggcaaattctggaatgaagctgtgtccactgcaaacctatctgtggtgaagagcctgctgcaggagcgacgaaggtggaaagttcaaatcaaaagagatattttgagaaaactccagccttgtcattcttcttgtaaaacctgcaatggatctgcaactctgtgcacttcatgtcccaaaggtgcatatcttctggctcaggcctgtgtttcctcctgtccccaaggcacatggccttccgtaaggagtgggagctgcgagaactgtacggaggcctgtgccatctgctctggagccgatctttgcaaaaaatgccagatgcagccgggccaccctctcttcctccatgaaggcaggtgctactccaagtgcccggagggctcttatgcagaagacggcatatgtgaacgctgtagctctccttgcagaacatgtgaaggaaacgccaccaactgccattcttgtgaaggaggccacgtcctgcaccacggagtgtgccaggaaaactgccccgagaggcacgtggctgtgaagggggtatgcaagcattgcccagagatgtgtcaggactgcatccatgagaaaacatgcaaagagtgcacgcctgagttcttcctgcacgatgatatgtgccaccagtcctgtccccgtggcttctatgcagactcgcgccactgtgtcccctgccataaagactgtctggagtgcagtggccccaaagccgacgactgcgagctctgtcttgagagttcctgggtcctctatgatggactgtgcttggaggagtgtccagcaggaacctattatgaaaaggagactaaggagtgcagagattgccacaagtcctgcttgacctgctcatcatctgggacctgcaccacctgtcagaaaggcctgatcatgaaccctcgtgggagctgcatggccaacgagaagtgctcaccctccgagtactgggatgaggatgctcccgggtgcaagccctgccatgttaagtgcttccactgcatggggccggcggaggaccagtgtcaaacatgccccatgaacagccttcttctcaacacaacctgtgtgaaggactgcccagagggctattatgccgatgaggacagcaaccggtgtgcccactgccacagctcttgcaggacatgtgaagggagacacagcaggcagtgccactcctgccgaccgggctggttccagctaggaaaagagtgcctgctccagtgcagggaaggatattacgcagacaactccactggccggtgtgagaggtgcaacaggagctgcaaggggtgccagggcccacggcccacagactgcctgtcttgcgatagatttttctttctgctccgctccaaaggagagtgtcatcgctcctgcccagaccattactatgtagagcaaagcacacagacctgtgagagatgccatccgacttgtgatcaatgcaaaggaaaaggagcgttgaattgtttatcctgtgtgtggagttaccacctcatgggagggatctgcacctcggactgtcttgtgggggaatacagagtgggagagggagagaagtttaactgtgaaaaatgccacgagagctgcatggaatgcaagggaccaggggccaagaactgcaccttgtgccctgccaacctggtgctgcacatggacgacagccactgcctccactgctgcaacacctctgatccccccagtgcccaggagtgctgtgactgccaggacaccacggacgaatgcatccttcgaacaagcaaggttaggcctgcaactgagcatttcaagacagctctgttcatcacctcctccatgatgctggtgcttctgctcggggcagctgtggtagtgtggaagaaatctcgtggccgagtccagccagcagcaaaggccggctatgaaaaactggccgaccccaacaagtcttactcctcctataagagcagctatagagagagcaccagctttgaagaggatcaggtgattgagtacagggatcgggactatgatgaggatgatgatgatgacatcgtctacatgggccaggatggcacagtctaccggaaatttaaatatgggctgctggatgacgatgacatagatgagctggaatatgatgacgagagttactcctactaccagtaa

SEQ ID NO: 23918 - DNA, 2845 bp, Homo sapiens
attgccactcagaatcctcgcgcgctgctcggagccggagggagcgctgggagcgagcaagcgagcgtttggagcccgggccagcagagggggcgcccggtcgctgcctgtaccgctcccgctggtcatctccgccgcgctcgggggccccgggaggagcgagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtgagctggcttccagtgggacacaggctaaaaagaggcagctcatgcatcatcccaccacatgggagaacagaatggaatggaatggaatgaaatggaatggaatgaaatggaatggaatggaatggaatggaatggaatggaatcgaatcgaatcgaatcgaatagaatagaatagaatagaacagaacagaatagaatagaacagaacaatctactacccatattctgacatattttcttccccttaaatatttgtgtgtgtatatcagtgcactcatatattcaaatatccatatgtgttatctgcaaagctaatagtccatattgcgattgtaccataatatagttaatctgtaatctgggacatattgttcgcttacagaattttacactattttaaacacggtttggataaacatcattatttatc

SEQ ID NO: 23919 - DNA, 2840 bp, Homo sapiens
attgccactcagaatcctcgcgcgctgctcggagccggagggagcgctgggagcgagcaagcgagcgtttggagcccgggccagcagagggggcgcccggtcgctgcctgtaccgctcccgctggtcatctccgccgcgctcgggggccccgggaggagcgagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtgagctggcttccagtgggacacaggctaaaaagaggcagctcatgcatcatcccaccacatgggagaacagaatggaatggaatggaatgaaatggaatggaatggaatggaatggaatggaatggaatggaatggaatcgaatcgaatcgaatcgaatagaatagaatagaatagaacagaacagaatagaatagaacagaacaatctactacccatattctgacatattttcttccccttaaatatttgtgtgtgtatatcagtgcactcatatattcaaatatccatatgtgttatctgcaaagctaatagtccatattgcgattgtaccataatatagttaatctgtaatctgggacatattgttcgcttacagaattttacactattttaaacacggtttggataaacatcattatttatc

SEQ ID NO: 23920 - DNA, 5137 bp, Homo sapiens
aacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatggagaatatgttgatgagcatggccactgccagacctgtgaggcctcatgtgccaagtgccagggaccaacccaggaagactgcactacctgccccatgacaaggatttttgatgatggccgctgtgtttcgaactgcccctcatggaaatttgaatttgagaaccaatgccatccatgccaccacacctgccagagatgccaaggaagtggccctacccactgcacctcctgtggagcagacaactatggccgagagcacttcctgtaccagggagagtgtggagatagctgcccagagggccactatgccactgaggggaacacctgcctgccctgcccagacaactgtgagctttgccacagcgtgcatgtctgcacaagatgcatgaagggctacttcatagcgcccaccaaccacacatgccagaagttagagtgtggacaaggtgaagtccaagacccagactatgaagaatgtgtcccttgtgaagaaggatgtctgggatgcagcttggatgatccaggaacatgtacatcttgcgctatggggtattacaggtttgatcaccattgttataaaacctgtcctgagaagacctacagtgaggaagtggaatgcaaggcgtgtgatagtaactgtggcagctgtgaccagaatgggtgttactggtgtgaagagggcttctttctcttaggtggcagttgtgtgaggaaatgtggtcctggattctatggtgaccaagaaatgggagaatgtgagtcctgccaccgagcatgcgaaacctgcacaggccctggtcatgacgagtgcagcagctgccaggaaggactgcagctgctgcgtgggatgtgcgtgcatgccaccaagacccaggaggagggcaaattctggaatgaagctgtgtccactgcaaacctatctgtggtgaagagcctgctgcaggagcgacgaaggtggaaagttcaaatcaaaagagatattttgagaaaactccagccttgtcattcttcttgtaaaacctgcaatggatctgcaactctgtgcacttcatgtcccaaaggtgcatatcttctggctcaggcctgtgtttcctcctgtccccaaggcacatggccttccgtaaggagtgggagctgcgagaactgtacggaggcctgtgccatctgctctggagccgatctttgcaaaaaatgccagatgcagccgggccaccctctcttcctccatgaaggcaggtgctactccaagtgcccggagggctcttatgcagaagacggcatatgtgaacgctgtagctctccttgcagaacatgtgaaggaaacgccaccaactgccattcttgtgaaggaggccacgtcctgcaccacggagtgtgccaggaaaactgccccgagaggcacgtggctgtgaagggggtatgcaagcattgcccagagatgtgtcaggactgcatccatgagaaaacatgcaaagagtgcacgcctgagttcttcctgcacgatgatatgtgccaccagtcctgtccccgtggcttctatgcagactcgcgccactgtgtcccctgccataaagactgtctggagtgcagtggccccaaagccgacgactgcgagctctgtcttgagagttcctgggtcctctatgatggactgtgcttggaggagtgtccagcaggaacctattatgaaaaggagactaaggagtgcagagattgccacaagtcctgcttgacctgctcatcatctgggacctgcaccacctgtcagaaaggcctgatcatgaaccctcgtgggagctgcatggccaacgagaagtgctcaccctccgagtactgggatgaggatgctcccgggtgcaagccctgccatgttaagtgcttccactgcatggggccggcggaggaccagtgtcaaacatgccccatgaacagccttcttctcaacacaacctgtgtgaaggactgcccagagggctattatgccgatgaggacagcaaccggtgtgcccactgccacagctcttgcaggacatgtgaagggagacacagcaggcagtgccactcctgccgaccgggctggttccagctaggaaaagagtgcctgctccagtgcagggaaggatattacgcagacaactccactggccggtgtgagaggtgcaacaggagctgcaaggggtgccagggcccacggcccacagactgcctgtcttgcgatagatttttctttctgctccgctccaaaggagagtgtcatcgctcctgcccagaccattactatgtagagcaaagcacacagacctgtgagagatgccatccgacttgtgatcaatgcaaaggaaaaggagcgttgaattgtttatcctgtgtgtggagttaccacctcatgggagggatctgcacctcggactgtcttgtgggggaatacagagtgggagagggagagaagtttaactgtgaaaaatgccacgagagctgcatggaatgcaagggaccaggggccaagaactgcaccttgtgccctgccaacctggtgctgcacatggacgacagccactgcctccactgctgcaacacctctgatccccccagtgcccaggagtgctgtgactgccaggacaccacggacgaatgcatccttcgaacaagcaaggttaggcctgcaactgagcatttcaagacagctctgttcatcacctcctccatgatgctggtgcttctgctcggggcagctgtggtagtgtggaagaaatctcgtggccgagtccagccagcagcaaaggccggctatgaaaaactggccgaccccaacaagtcttactcctcctataagagcagctatagagagagcaccagctttgaagaggatcaggtgattgagtacagggatcgggactatgatgaggatgatgatgatgacatcgtctacatgggccaggatggcacagtctaccggaaatttaaatatgggctgctggatgacgatgacatagatgagctggaatatgatgacgagagttactcctactaccagtaaacaggcactcccccaccaacaccaccattccactctcaggcatgcctgtgagcatcactgtttttggttttatccccacaccaggctgatgtgtgagtttttctatttgtcttctttaaccatgagtccaaccagaatatgtaagaatgatgaaatactttgttcttcttttgagtggctaaactcaattaacagttcctgttcaaccgtaattgaagagcaaggataaaattcagaggcattttcctcaaaataatgtgttaagacacaaaaatgaaggaagtgaaaacaaatgagatttgtacaaactcttctatgtgattttaaaaaaaggacagcagatctatagaaattctgtttccgagctgcattgtggaggtgtctgctgcctcctggtattctaatttttctttatctaattttggggataatggaggtacaaaggagttgttgg

SEQ ID NO: 23921 - DNA, 503 bp, Homo sapiens
tgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatgtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactatcaacatggactatcctgggaaagagctaggaagtagatgctgaggtccccatc

SEQ ID NO: 23922 - DNA, 9538 bp, Homo sapiens
atttatgcagagcaggagctgctgccattgccactcagaatcctcgcgcgctgctcggagccggagggagcgctgggagcgagcaagcgagcgtttggagcccgggccagcagagggggcgcccggtcgctgcctgtaccgctcccgctggtcatctccgccgcgctcgggggccccgggaggagcgagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatggagaatatgttgatgagcatggccactgccagacctgtgaggcctcatgtgccaagtgccagggaccaacccaggaagactgcactacctgccccatgacaaggatttttgatgatggccgctgtgtttcgaactgcccctcatggaaatttgaatttgagaaccaatgccatccatgccaccacacctgccagagatgccaaggaagtggccctacccactgcacctcctgtggagcagacaactatggccgagagcacttcctgtaccagggagagtgtggagatagctgcccagagggccactatgccactgaggggaacacctgcctgccctgcccagacaactgtgagctttgccacagcgtgcatgtctgcacaagatgcatgaagggctacttcatagcgcccaccaaccacacatgccagaagttagagtgtggacaaggtgaagtccaagacccagactatgaagaatgtgtcccttgtgaagaaggatgtctgggatgcagcttggatgatccaggaacatgtacatcttgcgctatggggtattacaggtttgatcaccattgttataaaacctgtcctgagaagacctacagtgaggaagtggaatgcaaggcgtgtgatagtaactgtggcagctgtgaccagaatgggtgttactggtgtgaagagggcttctttctcttaggtggcagttgtgtgaggaaatgtggtcctggattctatggtgaccaagaaatgggagaatgtgagtcctgccaccgagcatgcgaaacctgcacaggccctggtcatgacgagtgcagcagctgccaggaaggactgcagctgctgcgtgggatgtgcgtgcatgccaccaagacccaggaggagggcaaattctggaatgatattttgagaaaactccagccttgtcattcttcttgtaaaacctgcaatggatctgcaactctgtgcacttcatgtcccaaaggtgcatatcttctggctcaggcctgtgtttcctcctgtccccaaggcacatggccttccgtaaggagtgggagctgcgagaactgtacggaggcctgtgccatctgctctggagccgatctttgcaaaaaatgccagatgcagccgggccaccctctcttcctccatgaaggcaggtgctactccaagtgcccggagggctcttatgcagaagacggcatatgtgaacgctgtagctctccttgcagaacatgtgaaggaaacgccaccaactgccattcttgtgaaggaggccacgtcctgcaccacggagtgtgccaggaaaactgccccgagaggcacgtggctgtgaagggggtatgcaagcattgcccagagatgtgtcaggactgcatccatgagaaaacatgcaaagagtgcacgcctgagttcttcctgcacgatgatatgtgccaccagtcctgtccccgtggcttctatgcagactcgcgccactgtgtcccctgccataaagactgtctggagtgcagtggccccaaagccgacgactgcgagctctgtcttgagagttcctgggtcctctatgatggactgtgcttggaggagtgtccagcaggaacctattatgaaaaggagactaaggagtgcagagattgccacaagtcctgcttgacctgctcatcatctgggacctgcaccacctgtcagaaaggcctgatcatgaaccctcgtgggagctgcatggccaacgagaagtgctcaccctccgagtactgggatgaggatgctcccgggtgcaagccctgccatgttaagtgcttccactgcatggggccggcggaggaccagtgtcaaacatgccccatgaacagccttcttctcaacacaacctgtgtgaaggactgcccagagggctattatgccgatgaggacagcaaccggtgtgcccactgccacagctcttgcaggacatgtgaagggagacacagcaggcagtgccactcctgccgaccgggctggttccagctaggaaaagagtgcctgctccagtgcagggaaggatattacgcagacaactccactggccggtgtgagaggtgcaacaggagctgcaaggggtgccagggcccacggcccacagactgcctgtcttgcgatagatttttctttctgctccgctccaaaggagagtgtcatcgctcctgcccagaccattactatgtagagcaaagcacacagacctgtgagagatgccatccgacttgtgatcaatgcaaaggaaaaggagcgttgaattgtttatcctgtgtgtggagttaccacctcatgggagggatctgcacctcggactgtcttgtgggggaatacagagtgggagagggagagaagtttaactgtgaaaaatgccacgagagctgcatggaatgcaagggaccaggggccaagaactgcaccttgtgccctgccaacctggtgctgcacatggacgacagccactgcctccactgctgcaacacctctgatccccccagtgcccaggagtgctgtgactgccaggacaccacggacgaatgcatccttcgaacaagcaaggttaggcctgcaactgagcatttcaagacagctctgttcatcacctcctccatgatgctggtgcttctgctcggggcagctgtggtagtgtggaagaaatctcgtggccgagtccagccagcagcaaaggccggctatgaaaaactggccgaccccaacaagtcttactcctcctataagagcagctatagagagagcaccagctttgaagaggatcaggtgattgagtacagggatcgggactatgatgaggatgatgatgatgacatcgtctacatgggccaggatggcacagtctaccggaaatttaaatatgggctgctggatgacgatgacatagatgagctggaatatgatgacgagagttactcctactaccagtaaacaggcactcccccaccaacaccaccattccactctcaggcatgcctgtgagcatcactgtttttggttttatccccacaccaggctgatgtgtgagtttttctatttgtcttctttaaccatgagtccaaccagaatatgtaagaatgatgaaatactttgttcttcttttgagtggctaaactcaattaacagttcctgttcaaccgtaattgaagagcaaggataaaattcagaggcattttcctcaaaataatgtgttaagacacaaaaatgaaggaagtgaaaacaaatgagatttgtacaaactcttctatgtgattttaaaaaaaggacagcagatctatagaaattctgtttccgagctgcattgtggaggtgtctgctgcctcctggtattctaatttttctttatctaattttggggataatggaggtacaaaggagttgttggtttggtggtgtttttcttccctttagctgtctttaggcagaaatttgttttgtaagggccaagaaaagagggctcttatcaattgactccaggccacccctggtgagcagaagagaccacctgggctgggctgctcaggacctacttgagataagggaagaaaagagaaggtgcatcatagctgaggagccatgaggtcaccccaggccctagttcctccgcaggaatccagagtcacaacaattctaaaggcagagcaagcccagcgagaaagaaataactgaatttccaggaactgcactctcatgattttctgggtacttttcgcctgggagacatcagctaagacatcgaataataaaagaaaaatggcagtgttaacctaacataaaatggaataaaatgacaaacacttcatccgctctaaaaaattcagagctttccttcatcaacaacccatcacaaaaccgtggactctcaatagaaagagttggaatagagtctaacatggaaaaaaaaaaatcccaatatgctgctcacaagctgtactctagctgctgaccagccttccagcactgctcatcactatgatttttgtttctagacttcctaggcttccttttttccattcttctgtcaagtgtattcttggattcatgcaactgaggacagtttttgtccagattgtaacacagagaagggctcttgctatgcaaaatgatgttggcagggtcttacagatttccttgtcaaaatagaccttacaggcagtactagaaatggagcaccagaaagcaaaaatgacattttcagagaatgatgataattataatctattgcacacctactaccagataacaagctaagtaattcccccccaaaaatgccccacttatccattttggtacttaccatactcccatgaggttggtattgctattattctgttcttgtaggaaacctgaggcttacaagaggttaggtaactagtccaaggtcatgcaaagctcaacaaaattcaagaaaaaagaatgatcaccctaaagcgtgtgttcttataactatgctactgaaataaggtgggaaaataagcatcctaaatataattaaagtcatgcctattgttttagtctataatatcaatgttatctttactaaattcatggattttctttttttaacataatgtatcactgacacagaaaatctttatgaagaagtcttcagtttactaaaggcttgtgcttctttagaggaaagctcttaaaacagggttgacaaacagtctctggaaagagccagctagtaagtacattaggctttcttggccagaaagtctctgtcataaccactcagctctgctattatagcatgaatgcagctggtacataacggatgggtgagctgtgcttcaataaaaccttatttatggacactgacatttgaaattcaggtaattttcacatattataaaattttattcttcttttgatttttttcaaccttttaaaatttaaaaatgcaaaagctattctcagttcacagcattacaagaacaggtggtgggtcagatttggccaacaggctgtactttgctgactttatctttaaaacagttttcagagatcatacatgtacatgtatgatatgcctccaaaaattttgatcatttaaaattatctccttggccaggcgtggtggctcatacctctaatcctagcactttgggagactgaggcaggcagatcacctgaagtcaggagtttgataccagcttagccaacatggtgaaaccccatttctactaaaaatacaataaaaatctgggcatgttggtgcacacctgtaatcccagctactcaggaggctgaggcaggcaaatcacttgagcccgggaggcagaggttgcagtgagcggagatggcaccattgcactccagcctgggtgacagagcaagactccatctcaaaaaataagtaactaactaactaactaaataaataaataaataaaattatctccttgccaggactgctggctcatgcctgtaatcccagcactctgggaggctaaggcaggaggattgctgacccaccacctgttcttgagcccaggagttcgacatcagccttggacaacatagtgagactcccgtgtctacaaaaaatttaaaaattagccaggcatggtggcaagtgtctgtagtctcagctactcaggaggctaaggtggaaggatcacttgaacccgggaggtcgaggctgcagtgagctgtgatcttgctattgcacttcagcctgaatgacagagctaagaccctgactcaaaataaataaataacattatctcttcaaaatgtatctgaagccctgatagttctactttcaattcttagaaacatataaaaatatatgcatgatagccatcatatcaatggaagactttctcacctctgtggttgcagttagcttacaaaaacgagcaattttgcttatactgtgttgttcatcttccttgttaattctaaagctctgatagactgagtttgacatttctttctgtaaactggaaattgttttctatgaaaaaaaaactctatgatacacagttaaagattggttgaggttgagatgaacttcaatactaagaaaaattgtggtgttcctctgtgtggcctgcaatgaaaagaaggctcatgcttgtgtattgaggtttgacatctttccttctttgtttttagtcatgcaacgtcattcttagatggcttttgaatactatgctaatgactatctaaatagataaatatgtgattggaaaacaaagtcaccttttagttttctacttggaaatattaagagaatccttgtagactggaaacacaccaaaaggctgggtaaagcatgggaggttccagttaatagaaagtaattttaaaattggaaataaaattaaatcaagacca

SEQ ID NO: 23923 - DNA, 1497 bp, Homo sapiens
atctggaatgtccatcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaaggtgatcttgagactcctgttgcaaatcaactgaccacagaagagaggttcgtttccacactctcgattctgttccattggtctgtatatctatcttggagtcagtaccatattgttttgatcactgtagctttgtag

SEQ ID NO: 23924 - DNA, 2937 bp, Homo sapiens
atgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctcccccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaaggtgatcttgagactcctgttgcaaatcaactgaccacagaagagagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaaacagttgttgattgactgcatgaatgcgtgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattg

SEQ ID NO: 23925 - DNA, 4236 bp, Homo sapiens
atgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctcccccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggc

SEQ ID NO: 23926 - DNA, 4197 bp, Homo sapiens
atgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctcccccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggc

SEQ ID NO: 23927 - DNA, 3205 bp, Homo sapiens
tcgcgggccgaggacgcctctggggcggcaccgcgtcccgagagccccagaagtcggcggggaagttcccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcccccccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaaacagttgttgattgactgcatgaatgcgtgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattg

SEQ ID NO: 23928 - DNA, 2828 bp, Homo sapiens
ggggttagcgcctgcgctctggacggctttggggcagggcagatttatatctgcgggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgagtgctgaacaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagcc

SEQ ID NO: 23929 - DNA, 1809 bp, Homo sapiens
gggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccag

SEQ ID NO: 23930 - DNA, 1915 bp, Homo sapiens
gcgggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagcc

SEQ ID NO: 23931 - DNA, 2825 bp, Homo sapiens
ggggttagcgcctgcgctctggacggctttggggcagggcagatttatatctgcgggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcttcagcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagcc

SEQ ID NO: 23932 - DNA, 2866 bp, Homo sapiens
gctgagtcagggcgctgttgagctcgggcaggcccggatggggcggggttagcgcctgcgctctggacggctttggggcagggcagatttatatctgcgggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccaga

SEQ ID NO: 23933 - DNA, 1765 bp, Homo sapiens
attgcagactgcggagtcagacggcgctatgtacgccctcttcctcctggccagcctcctgggcgcggctctagccggcccggtccttggactgaaaggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcagcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgcta

SEQ ID NO: 23934 - DNA, 2319 bp, Homo sapiens
gcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgagtgctgaacaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtctcatagatgctccttttgaccttttcaaataaatatggatggcg

SEQ ID NO: 23935 - DNA, 2797 bp, Homo sapiens
atgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaatt

SEQ ID NO: 23936 - DNA, 8498 bp, Homo sapiens
aagtaaatcttgttgtggagcggagccctcagctgagggagcgctctgaaataatacaccattgcagccggggaaagcagagcggcgcaaaagagctctcgccgggtccgcctgctccctctccgcttcgctcctcttctcttctttacccttctcctctctcctcctctgctgctctctcctctcctcccgctcttctctctcctcctctcctgctctctcctcttcccttagctcctcttcttttcttctcctcttcttccctctcctcgcctctcccctgctcctcttctctcgtctcccctcccctcccgcctctctctcccctctccctctcccactcgccccgctcgctcgctcgctgtcgcacagactcaccgtcccttgtccaattatcatattcatcacccgcaagatatcaccgtgtgtgcactcgcgtgttttcctctctctgccgggggaaaaaaaagagagagagagagatagagagagagagagagagagagagagagaggctcggtcccactgctccctgcaccgcggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataatcactctcaagccttgtctaagaaaagaggcaaactctgaaagtcgtaccagtttcttctggaggcaaagcaattttgcacaaaaccagctctctcaagatgagactagaaattcatacctggtcttgtagccacctctctaaacttgaaaataggttcttcttcataagtgagcttacatcattcttcataaagaaaaatcctataacttgttatcatttttgcttcagatactaaaaggcactaagtttccaatttacgctgctcaactttgtttatatgcttaaaaggattctgtttacttaacaattttttcccctaaaatactattttctgaatacttccttccagtaaggaataaaggaaagcccaacttggccataaaattcttgcctacactagaagtttgttgacagccattagctgacttgatcgtcatctcctaagaggaacacatatattttcacaagcaattccacactatcctgatgggtatgcaaagtggtgacagtctaactcagtgtttcttcattttaggtataacattttaaagcaattgataatgcctcttccaattcagaagctagtattgaccaaaatgtgagaagagtgtatagcataggaaaatttggggttaacccaaaagacacaattccagcacacataagaaagctagctgctattttatgctttcttccatggttctcctcttttttcccttttatttttccctgtttttcaatgatgtacagtgttccctacttgcattgaaaaaactcgtatggcattcacactttttttcttaggtgggtttttgtgtccagatgcagtaagaattcattgttcatcctaaaactgttttccagacccttccttccccttaggtaatttgatatacacctcctaaaatgacacagtaacaaatctggtatttagaacatatagaacataaatgccattttttaattcaactttaataagaattacatttgactttggagaatacaggtcttgacccatgtgactgactagctgacccgatcgctgtaatttaacgtcatttataaattctgctgatggacaggaatgtatgaactcaattattgtcagcacaaagccttaaaacctgctgactttaaattaaatggtgcagtcctatgatgccctgcaccatccaggggactaacagggcctcgcagtgtagacagagggtgcagccacacgggcgggggcaccagccacctcactctgcacccgcggcctcacacatctcccagctcacactctactaatgcacagagtcattagatccaatttgttatttttctcacttgctttaaaaaaaagcagtttggataatcatgacattggaataaagtgggaaggaaaaattccatcagcacaaaatagggaagtaatcccaacttgtagtcacagttttctgactggctttgttttaaaagaggatggcagtccttgttcgtgtcagtgtgccactgggtttttgctgttccgtgtaattcatatcaactttgtgttgccatttgcaaggtaaaaggcaaagctgtagtgtattcacctatgtagacagattgctagatatctttttgatctggggcgagttcaatattgattccagacttatttggatttttttagtattattttcccctccctttctaatttaaatagacaaattaagcaaaagtgtgtgttcacaaccaaatgttgatgcccttatctactgataatatcctctcaatgttcactgaggcatagaaattatttcagagtagaaattgcagcatgaggataaactcacctctttgttctgaaaatagaactttatcactatgctttccggtggttttcccttttacaatcgaaatcttgtgcctcccaagtgcattggaaaatgacaaaagcctgtctctccaaattcctatttaacagtttgattttttttttttaatcaccatctttcaaatcttagctcaactctcaccaagtgaaaattggctacttgggagaaagttaactttctatggtgggatggtgaaggatgagggacagtttacataggaaaagaaaaaaaaaagtctaaagtccatgttgaaaaaccacactaccacttattttctgctaaccctaaattatttttgcgtatacgcttgaggttatagtctgtgcctagacctaaaatgcaccagcgggggggattttaaaaaatccttcaaaataccagttttttcccaacaagtacaattgttcttgtgccttctgtggctttcgatttcatctttttgactttatttccaattactacagctgcaataaacactagattttttttctggctgtttgacataacgttgatagctatgcatattttgtgtctttttaaaacaaagcgggagaatacgtttttgaagaagagaatttttagaacagtttgataccgcaaattattttttcctcaattgtttgagcagcattcgagttttgaaaattcttgtagaagccaattttttgtaactgtggtgcaaatcttgtgttttcttagcctaatgaaaagtagtatagaagcaatatttcataccatgtgctatatatgtgtgcgcagatgtgtgaacataaaatcacatacacacatatacacacatgtaaaaatatacatatatatatatgcgtgtgaagtggaaagcttaccttttcctatctagatttaagaacctattttagacatttgttatgttttgtgaaaagaatgttctatttgcaacaaaacatttaattcttactgtatctctggctgtttaatgaggacgtttcacattaaatggtaaaacacatggaagatgttagaatgtagtaattatttaagtaaacgttcacccacatattcctgaagtttgctttgtgcctccgagtattatttaattaaagaagtgttttatgtttgcagaatctttgtcactgtactagggatgtgggtgaatatcatttaaaaaaatttaaaacaacaaaaaaaaagcaaaacagaaacactaaagcaagaggggaacttttataaagcaatgtaaatatttaacctcatggctgtcattatgtaagacatgagattttaataaataactacattctcacgacatctgttgaatttactaggaacactacagtgactgtatagacagttgaaagcattcttgaaaatcctgctctctccttttaaaagttaacaatctcttttatcagatgtcaagggcaagggtaatgcagtttctgtaaatttatgaaatttctttttctatgtacatgaagacatttagtaagtaacacccccccttcccatgcgcacatgtgcgcatacacacacacacacacacacacacacacacaaacacacacactgtcataaagctaatgatttggggactttaaaaaataggatgtcctccaggaacaatcataaatttatgaaagaaagagtagtttacagactcccctgaaagaagcagtgtatatgtgaagacagtgcaaaaatctctttgccatgtatattatagcgtattcattggtgtgaatagtacaaatgtttccttctggtacaaactctgtgtttgcaaatttacaagaagcattgttttcaaaaagctccccttaaaaaatgtaactggtttatatgagtaagcagttaccgtattgcacttaaatgttatgttgaaggaaatgcagttttgttttctgtagatctgttggttgtaaaccatctataaaactaaagctaaaatgctcatattcagagctgggatcaaaactggtatttaacctttgcatcttcttataattatccttctaagaatataacagaatgtggaagtgtctggactttgagtcttttcaactgagccttctctcaaatctgacaccccctcagaatgcacaaacataagcagaaaaggcaaacaagcttaccttcttttgtgaaaacgtattcattctgtatttttttaaatattcaattcccctaaaaatggggagaaaatattttaaaattgtatattacgacttcaaatttagaactaagaaaaaaatgtatttgggattggtctcagcgctacctagaagaatcaaaggtcatggcttccctcaatattgtcccagccatttctcatatgtatatagtataaaccgtgacaaaacactgcctttatattatttagcaatatgttgtaaatagcattattaagctcttttttgtaataaagaccctttgatttgaatatagtacaataactgaactgataaagtcaatttttgatttttgtttgttttttttagctagaggcaatttcaattgtgaatttttgttgttgtctattgttctgaagactttgcataatttattggtttaatttatcctaatttatttgatgaaggtgtacaattttgtattaccaaggatgtactgtaatattaattgatatgataaacacaatgagactccctgtccatattaaaaagaaaataaaaaggtgcagtagacaattgattttaaaggaaaagttaaaaaaattagtttggcagctactaaattttaaaacaggaaaaaaaaaagttgttgtggggagggtgggaaaggggttttactttgtgtgttttaagcttttgtatactctccaaacttttaccttttgctttgtaccacttaaaggatacagtagtccaattgccttgtgtgccttccatctcctcttaaactgaatgtatgtgcagtatatatgcaagcttgtgcaaaataaaatatacattacaagctcagtgccgtttgattttcttaaagaaagagtgacttttaatttttggacctgtatccaattgtaggacagtaggctagttgtgccagtaatgtcaagtatggagattttctttcactacaattcttcattctgttagcctaacgtgcagctcctagaaacaacctcttttactttagatgcttggaataattgcttggatttctctctctgaaacatctttcaggcttaactttatttagccctgaaacttaaaaaaaa

SEQ ID NO: 23937 - DNA, 3069 bp, Homo sapiens
ccccttttccagaatcacttgcactgtcttgttcttgaatgagaaaggaagaaaagagcctcccattactcagacccgtgtaaacattattccccccaggagaaaatggtgttattcaaatgaatcataataaaatagcctctaaacagtttctaagcgggagcctccgtggaactcagcgctccgctcctcccagttcctaagaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaatt

SEQ ID NO: 23938 - DNA, 900 bp, Homo sapiens
ctggagaggagattcccagccttcctgcccaacccgaaacttttccaacacacgcaggcgtattcctcgcaggattcggcggtcccgagtcgcagtcagggaggaggctcgggaagcacacgtgccctggcacactggaggagggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaa

SEQ ID NO: 23939 - DNA, 3670 bp, Homo sapiens
agctgtgtcttaaagtaaatcttgttgtggagcggagccctcagctgagggagcgctctgaaataatacaccattgcagccggggaaagcagagcggcgcaaaagagctctcgccgggtccgcctgctccctctccgcttcgctcctcttctcttctttacccttctcctctctcctcctctgctgctctctcctctcctcccgctcttctctctcctcctctcctgctctctcctcttcccttagctcctcttcttttcttctcctcttcttccctctcctcgcctctcccctgctcctcttctctcgtctcccctcccctcccgcctctctctcccctctccctctcccactcgccccgctcgctcgctcgctgtcgcacagactcaccgtcccttgtccaattatcatattcatcacccgcaagatatcaccgtgtgtgcactcgcgtgttttcctctctctgccgggggaaaaaaaagagagagagagagatagagagagagagagagagagagagagagaggctcggtcccactgctccctgcaccgcgtaagtatcttcttcttcccctcgtgagtccctccccttttccagaatcacttgcactgtcttgttcttgaatgagaaaggaagaaaagagcctcccattactcagacccgtgtaaacattattccccccaggagaaaatggtgttattcaaatgaatcataataaaatagcctctaaacagtttctaagcgggagcctccgtggaactcagcgctccgctcctcccagttcctaagaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataa

SEQ ID NO: 23940 - DNA, 1640 bp, Homo sapiens
gtcttaaagtaaatcttgttgtggagcggagccctcagctgagggagcgctctgaaataatacaccattgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaatt

SEQ ID NO: 23941 - DNA, 2942 bp, Homo sapiens
cgcccgagccgcgcgcggagctgccgggggctccttagcacccgggcgccggggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaatttatcgcgcttactatggagcatttaaggatgtcaaggagaaaaacaggacctctgaagaagcagaagacctccgagccttgcgatttctatctgtgatttcaattgtggacccttggatttttatcattttcagatctccagtatttcggatattttttcacaagattttcattagacctcttaggtacaggagccggtgcagcaattccactaacatggaatccagtctgtgacagtgtttttcactctgtggtaagctgaggaatatgtcacattttcagtcaaagaaccatgattaaaaaaaaaaagacaacttacaatttaaatccttaaaagttacctcccataacaaaagcatgtatatgtattttcaaaagtatttgatatcttaacaatgtgttaccattctatagtcatgaaccccttcagtgcattttcatttttttattaacagcaactaaaattttatatattgtaaccagtgttaaaagtcttaaaaaacaatggtattaattgtccctacatttgtgcttggtggccctattttttttttttagagaggccttgagacatacaggtcttttaaaatacagtagaaacaccactgtttacgattatacgatggacattcataaaaagcataatttcttaccctattcattttttggtgaaacctgattcattgattttatatcattgccgatgtttagttcatttctttgccaattgatctaagcatagcctgaattatgatgttcctcagagaagtgaggtgggaaatatgaccaggtcaggcagttggaggggcttccccagccaccatcggggagtacttgctgcctcaggtggagacctgaagctgtaactagatgcagagcaagatatgactatagcccacaacccaaagaagcaaaaattcgtttttatcttttgaaatccagtttcttttgtattgagtcaagggtgtcagtaggaatcaaaagttgggggtgggttgcaaaatgttctttcagtttttagaacctccattttataaaagaattatcctatcaatggattctttagtggaaggatttatgcttctttgaaaaccagtgtgtgactcactgtagagccatgtttactgtttgactgtgtggcacaggggggcatttggcacagcaaaaagcccacccaggacttagcctcagttgacgatagtaacaatggccttaacatctaccttaacagctacctattacagccgtattctgctgtccgtggagacggtaagatcttaggttccaagattttacttcaaattacaccttcaaaactggagcagcatatagccgaaaaggagcacaactgagcactttaatagtaatttaaaagttttcaagggtcagcaatatgatgactgaaagggaaaagtggaggaaacgcagctgcaactgaagcggagactctaaacccagcttgcaggtaagagctttcacctttggtaaaagaacagctggggaggttcaaggggtttcagcatctctggagttcctttgtatctgacaatctcaggactccaaggtgcaaagcctgctgcatttgcgtgatctcaagacctccagccagaagtcccttccaaatataagagtactcatgtttatttatttccaactgagcagcaacctcctttgtttcacttatgttttttccagtatctgagataatataaagctgggtaattttttatgtaattttttggtatagcaaaactgtgaaaaagccaaattaggcatacaaggagtatgatttaacagtatgacatgatgaaaaaaatacagttgtttttgaaatttaacttttgtttgtaccttcaatgtgtaagtacatgcatgttttattgtcagaggaagaacatgttttttgtattctttttttggagaggtgtgttaggataattgtccagttaatttgaaaaggccccagatgaatcaataaatataattttatagta

SEQ ID NO: 23942 - DNA, 913 bp, Homo sapiens
gctcctcctgcacacctccctcgctctcccacaccactggcaccaggccccggacacccgctctgctgcaggagaatggctactcatcacacactgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggagactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcaaccctgcccactcaggcttcatcctgcacaataaactccggaagcaagtcagt

SEQ ID NO: 23943 - DNA, 921 bp, Homo sapiens
cacctccctcgctctcccacaccactggcaccaggccccggacacccgctctgctgcaggagaatggctactcatcacacactgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggag

SEQ ID NO: 23944 - DNA, 807 bp, Homo sapiens
ctcctcctgcacacctccctcgctctcccacaccactggcaccaggccccggacacccgctctgctgcaggagaatggctactcatcacacactgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcaaccctgcccactcaggcttcatcctgcacaataaactccggaagcaagtc

SEQ ID NO: 23945 - DNA, 369 bp, Homo sapiens
aggataccattgtcttcctgccccaaaccgtgcccagggagaggtgggaggtgatgggggatctgtgcagtttgggggctcagtcaagacgagctctgcgttacgggaggaacaggaagcccagtgggaaaattggcctaagtctggggttctgacgacagcccctggcttctttcttggcagataagtgcatgacggaacaataggactccccagggctgaagctgggatcccggccagccaggtgacccccacgctctggatgtctctgctctgttccttccccgagcccctgccccggctccccgccaaagcaaccctgcccactcaggcttcatcctgcacaataaactccggaagcaagtcagt

SEQ ID NO: 23946 - DNA, 754 bp, Homo sapiens
attgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcaaccc

SEQ ID NO: 23947 - DNA, 661 bp, Homo sapiens
ctcctcctgcacacctccctcgctctcccacaccactggcaccaggccccggacacccgctctgctgcaggagaatggctactcatcacacactgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggagactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaa

SEQ ID NO: 23948 - DNA, 989 bp, Homo sapiens
cctccctcgctctcccacaccactggcaccaggccccggacacccgctctgctgcaggagaatggctactcatcacacactgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaatagttccagggcacctggtacatggtcggggtggtgtcagatgaccaggacttcctggactccaaggacaccatgaagatggctgtggtcttagtgacccccttggggaatggtgacctggccctcaagtttggataccccacgccccatggcgggtgccagaaaatggacacgaccttcaccgagggtgctgtaccggggcagttcagcaacccagctcgagcgcccgagctgtttcccgaaggcgcccagaagatgcagctactggcgccccaagtgggcctgagccccagccagggcgtcctgctgccgaagtcggaccagtgtgcgggcgcgctctcccgggtgagtagaccat

SEQ ID NO: 23949 - DNA, 1421 bp, Homo sapiens
ggaagagggagggaggaagcggcttgccggagagccagggcgcagtgggcggcagggctgagcggccggtgatggggaccccacatcccaggcagtgccggcacccctggcgcctgacatgagcccttgcgggcccctcaacctgagcctggcgggcgaggcgaccacatgcgcggcgccctgggtccccaacacgtcggccgtgccgccgtcgggcgcttcgcccgcgctgcccatcttctccatgacgctgggcgccgtgtccaacctgctggcgctggcgctgctggcgcaggccgcgggccgcctgcgacgccgccgctcggccgccaccttcctgctgttcgtggccagcctgctggccaccgacctggcgggccacgtgatcccgggcgcgctggtgctgcgtctgtacactgcggggcgcgctccggccggcggggcctgccacttcctgggcggctgcatggtcttcttcggcctgtgcccgctgctgctgggctgtggcatggccgtggagcgctgcgtgggcgtcacgcggccgctgctccacgccgcgcgggtctcggtcgcccgcgcgcgcctggcgctggccgcggtggccgcggtggccttggccgtggcgctgctgccgctggcgcgcgtgggccgctatgagctgcagtacccgggcacgtggtgcttcatcggcctgggtcccccgggcggctggcgccaggcactgcttgctggcctcttcgccagcctcggcctggtcgcgctcctcgccgcgctggtgtgcaacacgctcagcggcctggccctgctacgcgcccgctggcgacgccgctcccgacggcctcccccggcctcaggccccgacagccggcgtcgctggggggcgcacggaccccgctcggcctccgcctcgtccgcctcgtccatcgcttcggcctccaccttctttggcggctctcggagcagcggctcggcacgcagagctcgcgcccacgacgtggagatggtgggccagcttgtcggtatcatggtggtgtcgtgcatctgctggagcccaatgctggtgttggtggcgctggccgtcggcggctggagctctacctccctgcagcggccactgttcctggccgtgcgccttgcctcctggaaccagatcctggacccttgggtgtacatcctactgcgccaggccgtgctgcgccaactgcttcgcctcttgcccccgagggccggagccaagggcggccccgcggggctgggcctaacaccgagcgcctgggaggccagctcgctgcgcagctcccggcacagcggcctcagccacttctaagcacaaccagaggcccaacgactaagccagcccaccctgggctgggcccaggtgcgcggcgcagagcctttgggaataaaaagccattctgcga

SEQ ID NO: 23950 - DNA, 2383 bp, Homo sapiens
gccgccgtcggcgcgctgggtgcgggaagggggctctggatttcggtccctcccctttttcctctgagtctcggaacgctccggctctcagaccctcttcctcccaggtaaaggccgggagaggagggcgcatctcttttccaggcaccccaccatgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaattgttccttggagaaatgaaaacagtgtgtaaacaaaatgaagctgccctaataaaaaggagtatacaaacatttaagctgtggtcaaggctacagatgtgctgacaaggcacttcatgtaaagtgtcagaaggagctacaaaacctaccctcagtgagcatggtacttggcctttggaggaacaatcggctgcattgaagatccagctgcctattgatttaagctttcctgttgaatgacaaagtatgtggttttgtaatttgtttgaaaccccaaacagtgactgtactttctattttaatcttgctactaccgttatacacatatagtgtacagccagaccagattaaacttcatatgtaatctctaggaagtcaatatgtggaagcaaccaagcctgctgtcttgtgatcacttagcgaaccctttatttgaacaatgaagttgaaaatcataggcaccttttactgtgatgtttgtgtatgtgggagtactctcatcactacagtattactcttacaagagtggactcagtgggttaacatcagttttgtttactcatcctccaggaactgcaggtcaagttgtcaggttatttattttataatgtccatatgctaatagtgatcaagaagactttaggaatggttctctcaacaagaaataatagaaatgtctcaaggcagttaattctcattaatactctttatttatcctatttctgggggaggatgtacgtggccatgtatgaagccaaatattaggcttaaaaactgaaaaatctggttcattcttcagatatactggaacccttttaaagttgatattggggccatgagtaaaatagattttataagatgactgtgttgtaccaaaattcatctgtctatattttatttagggaacatggtttgactcatcttatatgggaaaccatgtagcagtgagtcatatcttaatatatttctaaatgtttggcatgtaaatgtaaactcagcatcaaaatatttcagtgaatttgcactgtttaatcatagttactgtgtaaactcatctgaaatgttacaaaaataaactataaaacaaaaatttgaaaa

SEQ ID NO: 23951 - DNA, 2333 bp, Homo sapiens
gaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagataatgaaagaacggagttggacattttattgcaattcctgcttccctgaatttgcatatttcttcccacctgagaaggataattatatattttaatttggattatttcttcatttttatctttttattttaatgattgttttgtcagtaatacccatggagatcaactttattattataatccatgcctctgaatattagattggtttcttggatgggattttgaatatgcatttaagaagttgggaagaatttcacagatgatgattggaggaaaagtgatgaaaagaaagacctgtgttccaggagttttctccaacttcaaacctttacgtgaatcttaaccaaagtggacatctttacatttcatgatagcttgcttttgcaatatgagtttgaaaaatcagtataagcttatgatggtgaaaagtcaacatattgagagtgataattcaattaataggatatgaacttaacgacatataaaagcaaatgagggcaggagggaatcgtgacaaaaaatatttgtgcccaattatgattaatgttttagagatgttgtgtccctgtgggcttagcatggaactaaaagttcctaagtctcaattctagttatgtgtcatttagtaactcaggaatctgcttaattgttatttctaagcttttgatgacaaaggagtgatgcagctaagggcatccttggagtgtcataaaaaacaaatttgaggttgaatgattagctgcgcagttagagtgataaaaaaatccaggtaggccttctgattcaccatgaccaagtcaggatttcttaatatttcttttctggcagcatatacaaaggcaaaattaataaataacagttgttgaataacaaactttattacgtttttataaaataaaagaatctattttgtctgtattaaaataaaaaactttgtggacttctaaaagat

SEQ ID NO: 23952 - DNA, 2021 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctccagctgctctaatgatggacagaaagggcagcctatctcattatctaatgaaataatacagacagaagcaatcaggtaccacacaaacaactatgcatccagctccacctccttaccctgccagtgttcctcaaccttgatgtggagcgaccatttggaaagatgagaaaaagaagactcagagagcaagaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgttt

SEQ ID NO: 23953 - DNA, 1504 bp, Homo sapiens
cctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaattctggaggccggcaagttcaggatcagggtgccagcagattcggtgtctgatggagtcttgctctctcacccagactggagtgcagtggagtgatttccgctcactgcaaccttcacctcctccactcactgcaatcttcgcctcctgggttcaagtgattctcctgcctcagcctcccaagtagctggaattgcaggcatgcgccacaagcctggctaatttttgcatttttagtagagatgaggtttcaccatgtttgccaggctggtcttgaacacctgacctcaagtaacccacccaccttggcctcccaaagagctgggattacaggcatgagccaacgtgcctggccatgttctgatcgtttaatgatagca

SEQ ID NO: 23954 - DNA, 1943 bp, Homo sapiens
gaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaattaatctgcagtttgcagaactctcagatacagagggcaactgcacattgtgggcaagtacaaacctatcgtgtgctgaacagagaagaaatggaggtactcgtgagcagcattaatgtgtacaccagaatctcaacagtaaagacagaataacatgaagaaaataactacaggagtgctgtgttttaaaaaagcaagctcctccagctgagtttgtgactctaatccctgcttattttgagcactttccatgtgttgattgactcggaaaggtgggagattaccagcaagccaggtcatttgggcaaacatgggcatatttttagcaaagctgaacaaactggttggtcactcgaactacccaatttagacttatagtaagaatagcacatggttcagaattgccaagactgctgctttagtcaacagaaattttttcatatgcatgctggtaatgcagtgcatctctggaagaaatgcaagagtattttaacatttggtccagaagaaatatgtaaagggtgtttgtagaatttgatgccctcttcagtgacataaggttatgggtttgtgaatggaaaatctgttatttgttcaggttattaaaacacattctaattcaacatca

SEQ ID NO: 23955 - DNA, 1922 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagagatggggcctgatggaaggtgtttttgtcatgcatggaggcaggtccccaggacttggtgcagttctcatgatagagaaccctgcagtgtccagctaagctgatgacttgaagataaatctgcctaaccctgggatgaagtatctgtgaactattttgacagcagatgaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtac

SEQ ID NO: 23956 - DNA, 6754 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctccagctgctctaatgatggacagaaagggcagcctatctcattatctaatgaaataatacagacagaagcatgaaagaaaacacttaacttgcatgtgcacagcttttggtaacaaatatcgctaaaccttactgtgaatttaggcatctctggcatgccactgtttatgcattgaagtggaatttttggtataaagctaaatggtcttagaagcatagaaaatccctatgtgccaaaagtagtgaaacacaaacaaaggaaaatatattaataacagtctagtgtttttgttgagtctgccattcgtagctgaatatgtgattaattatgtgatgaaaacattttttataaatgatcttggtctattggggagcggggatagttaatattccagtacactgaatacatgaggaatttaaccacatacatcattgaagacaagggatagcagtttgtttttattcaaagacattgctgtgttctctttcattgcctctctcgctttctgtcacttttttcctccttacattaaagaaaagtttaattacagttaaaaatgtataatgtatttataatattcatcgataccattattcaaatattgctcaatacagcaaattagctcctaacctaacaaagtttaagtttacttggattgataattaggtttactctttatctgaataagaaccaattccatttgtttgaaatatggagtttgtgactacccaaattgctaattattctttcttttgaatatattttacatttctatgagcctaaggaagattcatgaaactgacctatgagagtcgtgaagtggtttttcagaatgctatgtaaggaccgatttgagcactaactataggtactctgaatatatatttcccttgattattcaccaaaagtgttccccagtctttgactctttaaattccaatactgattccaaaacaaataaatattttgaagactcaatgaatactttccatattttggcctatttatataagaaagttaataacattgacccttcacagctcttctgcctgctcctcaaagtggctctatctaaatatttattactaaaatgtttttcctacagtctacatgaatacaaacctcaatagctaagcttgacgtatttgtgcacaagtagatcactacattaagttttgggaattgcacttcttaaaaatgtctccccaccaaacatagtaatcctgtagttatgcctacacaaagcttgccatattctttggtgcattcattttgtaaacccattaactttttattgtgaagattttcatttgcagtttcttgcactgcttttctagttttttaaaagcttgagatttatttatacttcttgtagtaactgcatatttctgtgtgtgtttagtggtaaagaattaattttgataggtacaatatgtctatcagattgatatatacaccagcctatgtcaattggggctaattattttaaatgaccatgtcaaattgaatttggagacaaaatctgttgagagtgcttatgtaattaatgatggttctactaatctaaattttggaaaaggtgataaatagactatactaaaatctctctatgccatagaattggattatcctgtaggtcatctcattgggtataagacaaaactacctactttttttcaaaagtgcactgaaatcacataataaagaggctttacctcttggttggtcctgtgaccctaagttctagtcagatagacacagaggcaatgtgaatttgagtggcatgagcatgattaggttattccttccagcatctagtatagcacctggaatatagaaactgtctaatacatatttattcagtgaatcaatgagcagaagtttgccaggacagtacacattggcaaggcacataccatatgattgaagtgcttcatgccattacagtccatcaggctgataaagtgaattatttctgattatttaattacagaaatatgaatttatcttcaagggtgtagtgtcatactgctgtacaacacagtgctttatttatactaataatttaggagactgatacttccaaatgatagtggacattactatcacaagaatatcacttttcatcaaactgcaaaaatacagaaaggcaaaaaacctgacacttattcttaactgcaaattaaattcctgcccaggggatatattttaggaggggatgaatggcagcttttgtgttttttttaacaagcttgaaagggaggtggaaaacaaagaaattatgtaaatggcatatgagttttattatctaggcattcgttagtatggggaaacctgataagaaatgaaaatcccaaatgatttcagccttttcatgatggttgaggttagatttcagagatgtacagagactagagcggtggttagaaagaggatatatgtagtcacagcagaaagacgtgtctaagtttaattttattggctttcaagttcactcatgtatacttagtttgtccatacatatgtctaatcaggaaaaatgcatgtatagattatgacaattcctgaattttgaagtattggttaaaagacaattaaaggccaagaaaaccatggtggaagaagtaagcgaatgaaatgtagaaatatatgtaaaattagcaagtgtcaattttaccaagtagtgttgattttccaaacaatgaatttatatactatgctgagtcacagagaagaatgatcacatgttacttaatgagagcagtttacttttcaaataaaataggtatgatgaatgtcttaaaaatatcttgaagttgaagaaacaaaaatgagttatctcaatatttaccaagttaacctagtgctgtatatatcccaagatattttaggtaaatgtaagtgtttaatcatgccagatttaaactagtctgaaatatagggtatacatatatttctacttacatttctttattttatgaaatatccgaccatgttgcagaaaataatgcaaaacctcatgtaagttaactatgaaagatcctgtgagcacattggcattgagtgacagacaaactaaaaactggcaaacagtattttaataagggggtcactctgtggcagtattctaatattggattttcaagtagattaggctttttatttattcaacgctttttataattttgttctttttgactccaaattattggtcagctttcaaccttctccacatcagcaatcactaatagttcttttggttgagatcaactcagaaaaagaaaatagaaaacttttgttctttgaaattttagacatgcataatatctatttattttcataatttaaccccaaaagcttctcctgcaatacacaggattctaggagctgaatgacacagggagactacagagtatttattattacaaacacataaaaagcctaacttgaagaattaaaatttctattttttatctgtataacaagtacaaaccatcaacaatgacaaattttcacagctgcttgtttattgcttgttttatatgtttacatatctcaaaatctgttaaaactgaggtctaaaaaatgtgcagaattgtgcaactgtggcctagtccataagacttttctgagttgcaacaaagtgctgacaaagtgacagatgtctgtgatgtttcatgacataggttatgatcgagccaatttacaaaatttaataaccaacctaaactcacatacatatttgttaagaagctgacatcagttcagtattgtaaggaaactaactaggtggtgatgatgataaaagaattagggaaaatattttatttgatatattcccttttataattcctaaaatgaagattctatttaagggttataatttatataagtttagtcatataccattacattatgataccataagcagagtgcattatgattctctagaaatataattcaatcagatatgtattatatttatttatgtcacacattttctttactgagaataaaaattatcttattttcagaagctttgtatcaatcagtttcatgtaataagcaacccagatatctactagattatgtatttcttcatttgaaactacactgttttctcctagtccccttgactctactgtgcttatccattctttcacagaaagaaagtaacagacataattcctgttgatgaggctgggattgtttttaagaggagagataataacttcatatttttaaagtgccagtagcctaatatgtgaaacagatcagaatctgttgtgtagtaagtctgctttgttgaagaatttattatgggagtaaagataagaaggaaagagatcaccatcagaaacaagtcagccttttcatgcttttttgagcatttttggagatgattccacttctcaagttattatcatttgtgcatctcttcaatgctattgttaaatgctttagaattagaatattttgatcctttaattaaagtaagccaaacgtctaggcaaaaacagccaatcattaaactttaatagtaattcaaatatagatttctcatacagttttccatgtctgtagaaatcaaagttgtaatgttaagcagagggaaatgcgtgtgatttactaatacacttcaacgttctacttttgaaaggatactcatgtgggtggggcagagaacatagaaaaagatatgatggaaaacctgtccattttctacctgttaaccttcatcattttgtgccaggccctggaagcaaagagaggaagggaccgactgcatttatctttgaacacttgagcatcagtagtactactgagtggccaggggtcttgtctgtcaaagcaaatgataagttcactcaggccattattgactgctgaactctcttccttcccaactcttccttgaaagagaaaaaaatactttgccttcttgctctccttatcaaatgtttttgtacaaatagtgtaagcctgtttaagcaaaccaattaaaataggcactgattattttgatctgtttgtaacaaatgaatgtaagtactatttacatggtgtgcctaggaggagctgaaatcattggcactttaatccatattgtaaagatcagtatcaaaagcatagtgttcttcacctctcctcctcagcatccatctctatatacttgattaaatggaaaagtctcttttatcacctctatgtaaagttttatgggtagttatcgtcagtgtatttaaatatatcttctagtatgttttaaaggctggtcttcaatactgtggagacaaaaaataaaagagcgtatgaaaagtacgttagacttttgctggcattcaagtcatggctagtctgtgtatttaataaatgtgtgttatttatgtcgtgtttgtcaatggaaaataaagttgaatattctgaaa

SEQ ID NO: 23957 - DNA, 1914 bp, Homo sapiens
gaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagatgagaaaaagaagactcagagagcaagaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgttt

SEQ ID NO: 23958 - DNA, 1815 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgttt

SEQ ID NO: 23959 - DNA, 1596 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctccagctgctctaatgatggacagaaagggcagcctatctcattatctaatgaaataatacagacagaagcaatgagaaaaagaagactcagagagcaagctcctcttcttcccacctctactgtgattgatccttcaaggttctgtgctcagcccttccgttggttcttggatttgtcctttcccgccatgtcttcatcacatccacaacttccactaacacttgcgagcttcaaacttcttagagaaccctgcagtgtccagctaagctga

SEQ ID NO: 23960 - DNA, 2055 bp, Homo sapiens
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagatgagaaaaagaagactcagagagcaattaatctgcagtttgcagaactctcagatacagagggcaactgcacattgtgggcaagtacaaacctatcgtgtgctgaacagagaagaaatggaggtactcgtgagcagcattaatgtgtacaccagaatctcaacagtaaagacagaataacatgaagaaaataactacaggagtgctgtgttttaaaaaagcaagctcctccagctgagtttgtgactctaatccctgcttattttgagcactttccatgtgttgattgactcggaaaggtgggagattaccagcaagccaggtcatttgggcaaacatgggcatatttttagcaaagctgaacaaactggttggtcactcgaactacccaatttagacttatagtaagaatagcacatggttcagaattgccaagactgctgctttagtcaacagaaattttttcatatgcatgctggtaatgcagtgcatctctggaagaaatgcaagagtattttaacatttggtccagaagaaatatgtaaagggtgtttgtagaatttgatgccctcttcagtgacataaggttatgggtttgtgaatggaaaatctgttatttgttcaggttattaaaacacattctaattcaacatca

SEQ ID NO: 23961 - DNA, 1447 bp, Homo sapiens
tgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgt

SEQ ID NO: 23962 - DNA, 3848 bp, Homo sapiens
aaaacaactgccctctcttccacgatctagatgttgcggcccgcggacaggaggttcaagaaatagtacactccgagcggcaggcagcgaggcggaaacggtcgccggtttcagtggtggccccactggaagccgagttcaggagcggctaagcggtcgccggggaaagcaccggggcttcccagggtcccctccgagttcccactccgcacctccgagggcgtgaaaaccacgggagccgccccaccccgcgcgcccagccccgccccagcccagacaccgccccccgccagtcttccctgcggcgcccagggaggacgcgctccgcccccttccaatccggccaatgggcgcccgggcagcgcgcggtttgcctccgcctccgccagggaaacttggaggaggagaaaagtttgtacagagggtggaaaggcgagagcggagctccaagcccggcagcccgagaggaagatgaacagccccaggccagagcctctggcagagtggaccccgagccgcccccaggtagccaggagcggcctcagcggcagccgcaaactccagtagccgcccgtgctgcccgtggctggggcggagggcagccagagctggggaccaaggctccgcgccacctgcgcgcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtcttactggtggatgaggctggtgggagcggcagggctgggcctgcccctaaggggagctccctgcaagtcacatttcccagtgaaacactgaacttatcagaaaaatgtatataataggcaaggaaagaaatacagtactgtttctggacccttataaaatcctgtgcaatagacacatacatgtcacatttagctgtgctcagaagggctatcatcatcctacaactcacattagagaacatcctggcttttgagcacttttcaaacaatcaagttgactcacgtgggtcctgaggcctgcagcacgtcggatgctaccccactatgacagaggattgtggtcacaacttgatggctgcgaagacctaccctccgtttttctactagataggaggatggtagaagtttggctgctgtcataacatccagagctttgtcgtatttggcacacagcagaggcccagatattagaaaggctctattccaataaactatgaggactgccttatggatgatttaagtgtctcactaaagcatgaaatgtgaatttttattgttgtacatacgatttaaggtatttaaagtattttcttctctgtgagaaggtttattgttaatacaaggtataataaaattatcgcaacccctctccttccagtataaccagctgaagttgcagatgttagatatttttcataaacaagttcgagtcaaagttgaaaattcatagtaagattgatatctataaaatagatataaatttttaagagaaagaatttagtattatcaaagggataaagaaaaaaatactatttaagatgtgaaaattacagtccaaaatactgttctttccaggctatgtataaaatacatagtgaaaattgtttagtgatattacatttatttatccagaaaactgtgatttcaggagaacctaacatgctggtgaatattttcaactttttccctcactaattggtacttttaaaaacataacataaattttttgaagtctttaataaataacccataattgaagtgtataatataaaaaattttaaaaatctaagcagcttattgtttctctgaaagtgtgtgtagttttactttcctaaggaattaccaagaatatcctttaaaatttaaaaggatggcaagttgcatcagaaagctttattttgagatgtaaaaagattcccaaacgtggttacattagccattcatgtatgtcagaagtgcagaattggggcacttaatggtcaccttgtaacagttttgtgtaactcccagtgatgctgtacacatatttgaagggtctttctcaaagaaatattaagcatgttttgttgctcagtgtttttgtgaattgcttggttgtaattaaattctgagcctgatattgatatggttttaagaagcagttgtaccaagtgaaattattttggagattataataaatatatacattcaa

SEQ ID NO: 23963 - DNA, 1774 bp, Homo sapiens
tgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaaggcctttgccaaccccgaggatgccctgagacacggaggcccccagtattgcaggagcgaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagctgatgcctccttggccaccagaccatgggccaagagccgccgtggctatacctggggacttgatgttccttccagattgtggtgggccctgagtcctggtttcctggcagcctgctgcgcgtgtgggtctctgggcacagtgggcctgtgtgtgtgcccgtgtgtgtgtatgtgtgtgtgtatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatcccgggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctgccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgggaggggcccacaggaagctcagccttctcctcccaaggtttgagtccctccaaagggcagtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgtgtgttttctcctagacccgtgacctgagatgtgtgatttttagtcattaaatggaagtgtctgccagctgggcccagcacctcg

SEQ ID NO: 23964 - DNA, 1415 bp, Homo sapiens
gcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcggctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgggacggcagatatgaaatgcctggcacagtgcttggggtctagtatgtagcttccagaacccaccctgcccctctacctgggaggccaaatggcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcgttcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagca

SEQ ID NO: 23965 - DNA, 2331 bp, Homo sapiens
ctctcgggcgccgggcggggccatcccggggctgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgaggagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcgttcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatgga

SEQ ID NO: 23966 - DNA, 4450 bp, Homo sapiens
gtgcgcggaggggacgagcggctggaccacagccggcgcccgatcaggatctccgcgctgggatcggtggaacttgaggcagcggcggcgcggggcgccatggcacaccgagcggctccgtcttctgctcctcagagagcccggctggcggcctgggatgacaagatgtctggactgcaatcctgcacagttttgagagggagatgacttgagtggttggcttttatctccacaacaatgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagtggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctgggatacagaataattttgaatgggaaagagaaatataaagtatatgaagagcaaagtgatttcttacataggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcatatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaaactctaccatggataatgcaaacaaaccgaagctacatgccaatgataggtgcaaagaatattggcaaaaggtgctttaccttgagccattatttgtgtcagagaacaaaagaaacagaatcaatatataaaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagactttttctttgcttgtttgtgtaattcaaccaaaagaatttcaatacccattcaaattgtcctaggtctatcagaaattagggaaggtagtcctgctttataataggaaaatgtatttctgtataagagttctttgctttcattaacttggattcatttaaaaattaatcttccctgttaggctgatttcagattctctaggaaatctgtgtaagtaaccagaagacctttcagatggtttatttgctttcagcagagaatttatttcatacagttacttaagagtgttgatgtcttgtgaacagagatataaggaaccattctccatccttccttatcatgctgggtacaatgcttctatgaatatttccatgtattttgactggggagaggcatggagaagaaactctcattcaggggctccaggatccttctccttgaggcttctaaataaatggcagaattcttgctgtattgccatgatgtcaccctggccatgtgtactgacttgaggagatcttgcaacatggccatgtgcaaggctttaaggagtgagagagatgtgtacatatcttaggagggttatctatgttatctgagtatatgtttgggtaaccaaattggtcttaaaaatgatgttaacccaagaagtagacatcaaaaattaaaaaaaaaaaaaggaatgtgttttcattgttttaagtttttcttctgagtaaaacaaaattatagaaaacaaatgcaacaatgtgcacatctgacttaagagtttcatttctgttattatatgtgttgcatgtagcttggcgatttactgtgtaatgaataatagactggaacatctaccaataactttcacataaatgttcaaaatagaagtgtattttttcaggtttctggaaataaatagtaaaataaatggcacaaatagtttcaataaatttaccaatttgagtgttttcagctctatttcaaaactcataactaatcttcagaattactgaatttccttttgaactgggtaaggcattatccaagcaacttcacatactatttaaacatgatttctcggtaattatatattctgggcaaataacataaacatgtcaggatttttacaggtgttagtgaatttttctaaaaagatgagacaaaagcaaaaatatcacacataggtttttatgactatgaatacaaagataatgctgattcacaattagctatgggtaagtccaaaacatcagaccttttactgatgggttaactaggtgaaagaaatgggcccttatttttttttttccctagaggcagaaagttacttctaatgatctatatagctaaaacgaaaaatacctgaaagttaatacatacatatgtagatatattttgttatgtgataaatgtttcttgtttgcacacttttggacttgagaaatctgcttttgttttgtgcctactctgagtttagaacccaaataagaggacttgttaaatatagagtgtactttttgttaaaactattgctagcttcacctgtataccatcattgttccaaattaaataactgttttgggtcagaatataaatgctgggaatatacattttattacttcttaatctgggtgtcaaagattttaccacctggtaaataatgttggacttcaacttgttactggcacattttaatagtagatgaaacatgtttttcttggttatgtgaataaatgtatgttgtgctcttcatacttgttggattgtatagagattaaatagtgatatgtatattttgttgtttgctttggtatgcaactcatgtaattttagtgctttgactagcttaaaacttcaaacaagtaattttataataaagttggactaatgtt

SEQ ID NO: 23967 - DNA, 4379 bp, Homo sapiens
gtgcgcggaggggacgagcggctggaccacagccggcgcccgatcaggatctccgcgctgggatcggtggaacttgaggcagcggcggcgcggggcgccatggcacaccgagcggctccgtcttctgctcctcagagagcccggctggcggcctgggatgacaagatgtctggactgcaatcctgcacagttttgagagggagatgacttgagtggttggcttttatctccacaacaatgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagtggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcatatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaaactctaccatggataatgcaaacaaaccgaagctacatgccaatgataggtgcaaagaatattggcaaaaggtgctttaccttgagccattatttgtgtcagagaacaaaagaaacagaatcaatatataaaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagactttttctttgcttgtttgtgtaattcaaccaaaagaatttcaatacccattcaaattgtcctaggtctatcagaaattagggaaggtagtcctgctttataataggaaaatgtatttctgtataagagttctttgctttcattaacttggattcatttaaaaattaatcttccctgttaggctgatttcagattctctaggaaatctgtgtaagtaaccagaagacctttcagatggtttatttgctttcagcagagaatttatttcatacagttacttaagagtgttgatgtcttgtgaacagagatataaggaaccattctccatccttccttatcatgctgggtacaatgcttctatgaatatttccatgtattttgactggggagaggcatggagaagaaactctcattcaggggctccaggatccttctccttgaggcttctaaataaatggcagaattcttgctgtattgccatgatgtcaccctggccatgtgtactgacttgaggagatcttgcaacatggccatgtgcaaggctttaaggagtgagagagatgtgtacatatcttaggagggttatctatgttatctgagtatatgtttgggtaaccaaattggtcttaaaaatgatgttaacccaagaagtagacatcaaaaattaaaaaaaaaaaaaggaatgtgttttcattgttttaagtttttcttctgagtaaaacaaaattatagaaaacaaatgcaacaatgtgcacatctgacttaagagtttcatttctgttattatatgtgttgcatgtagcttggcgatttactgtgtaatgaataatagactggaacatctaccaataactttcacataaatgttcaaaatagaagtgtattttttcaggtttctggaaataaatagtaaaataaatggcacaaatagtttcaataaatttaccaatttgagtgttttcagctctatttcaaaactcataactaatcttcagaattactgaatttccttttgaactgggtaaggcattatccaagcaacttcacatactatttaaacatgatttctcggtaattatatattctgggcaaataacataaacatgtcaggatttttacaggtgttagtgaatttttctaaaaagatgagacaaaagcaaaaatatcacacataggtttttatgactatgaatacaaagataatgctgattcacaattagctatgggtaagtccaaaacatcagaccttttactgatgggttaactaggtgaaagaaatgggcccttatttttttttttccctagaggcagaaagttacttctaatgatctatatagctaaaacgaaaaatacctgaaagttaatacatacatatgtagatatattttgttatgtgataaatgtttcttgtttgcacacttttggacttgagaaatctgcttttgttttgtgcctactctgagtttagaacccaaataagaggacttgttaaatatagagtgtactttttgttaaaactattgctagcttcacctgtataccatcattgttccaaattaaataactgttttgggtcagaatataaatgctgggaatatacattttattacttcttaatctgggtgtcaaagattttaccacctggtaaataatgttggacttcaacttgttactggcacattttaatagtagatgaaacatgtttttcttggttatgtgaataaatgtatgttgtgctcttcatacttgttggattgtatagagattaaatagtgatatgtatattttgttgtttgctttggtatgcaactcatgtaattttagtgctttgactagcttaaaacttcaaacaagtaattttataataaagttggactaatgtt

SEQ ID NO: 23968 - DNA, 4337 bp, Homo sapiens
catgaggaaatgtagctgtatgcctggagggatctacagccagaccagccaactcagcctggttaagaacacctgttgaagaactagtgcaggcgtttggaggacataggacactctggccatatgtctggactgcaatcctgcacagttttgagagggagatgacttgagtggttggcttttatctccacaacaatgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagtggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcatatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaaactctaccatggataatgcaaacaaaccgaagctacatgccaatgataggtgcaaagaatattggcaaaaggtgctttaccttgagccattatttgtgtcagagaacaaaagaaacagaatcaatatataaaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagactttttctttgcttgtttgtgtaattcaaccaaaagaatttcaatacccattcaaattgtcctaggtctatcagaaattagggaaggtagtcctgctttataataggaaaatgtatttctgtataagagttctttgctttcattaacttggattcatttaaaaattaatcttccctgttaggctgatttcagattctctaggaaatctgtgtaagtaaccagaagacctttcagatggtttatttgctttcagcagagaatttatttcatacagttacttaagagtgttgatgtcttgtgaacagagatataaggaaccattctccatccttccttatcatgctgggtacaatgcttctatgaatatttccatgtattttgactggggagaggcatggagaagaaactctcattcaggggctccaggatccttctccttgaggcttctaaataaatggcagaattcttgctgtattgccatgatgtcaccctggccatgtgtactgacttgaggagatcttgcaacatggccatgtgcaaggctttaaggagtgagagagatgtgtacatatcttaggagggttatctatgttatctgagtatatgtttgggtaaccaaattggtcttaaaaatgatgttaacccaagaagtagacatcaaaaattaaaaaaaaaaaaaggaatgtgttttcattgttttaagtttttcttctgagtaaaacaaaattatagaaaacaaatgcaacaatgtgcacatctgacttaagagtttcatttctgttattatatgtgttgcatgtagcttggcgatttactgtgtaatgaataatagactggaacatctaccaataactttcacataaatgttcaaaatagaagtgtattttttcaggtttctggaaataaatagtaaaataaatggcacaaatagtttcaataaatttaccaatttgagtgttttcagctctatttcaaaactcataactaatcttcagaattactgaatttccttttgaactgggtaaggcattatccaagcaacttcacatactatttaaacatgatttctcggtaattatatattctgggcaaataacataaacatgtcaggatttttacaggtgttagtgaatttttctaaaaagatgagacaaaagcaaaaatatcacacataggtttttatgactatgaatacaaagataatgctgattcacaattagctatgggtaagtccaaaacatcagaccttttactgatgggttaactaggtgaaagaaatgggcccttatttttttttttccctagaggcagaaagttacttctaatgatctatatagctaaaacgaaaaatacctgaaagttaatacatacatatgtagatatattttgttatgtgataaatgtttcttgtttgcacacttttggacttgagaaatctgcttttgttttgtgcctactctgagtttagaacccaaataagaggacttgttaaatatagagtgtactttttgttaaaactattgctagcttcacctgtataccatcattgttccaaattaaataactgttttgggtcagaatataaatgctgggaatatacattttattacttcttaatctgggtgtcaaagattttaccacctggtaaataatgttggacttcaacttgttactggcacattttaatagtagatgaaacatgtttttcttggttatgtgaataaatgtatgttgtgctcttcatacttgttggattgtatagagattaaatagtgatatgtatattttgttgtttgctttggtatgcaactcatgtaattttagtgctttgactagcttaaaacttcaaacaagtaattttataataaagttggactaatgtt

SEQ ID NO: 23969 - DNA, 6178 bp, Homo sapiens
gatttatcggctcgcgaggagagcggagcaggcgcgcggcccaggcggaggagcgccgactctggagcagccggagctggaagaggaggaggaggagaggcggcggggaaggaggaggagggggagagtcgctcccgccgggcgagcatggggcgcctggcctcgaggccgctgctgctggcgctcctgtcgttggctctttgccgagggcgtgtggtgagagtccccacagcgaccctggttcgagtggtgggcactgagctggtcatcccctgcaacgtcagtgactatgatggccccagcgagcaaaactttgactggagcttctcatctttggggagcagctttgtggagcttgcaagcacctgggaggtggggttcccagcccagctgtaccaggagcggctgcagaggggcgagatcctgttaaggcggactgccaacgacgccgtggagctccacataaagaacgtccagccttcagaccaaggccactacaaatgttcaacccccagcacagatgccactgtccagggaaactatgaggacacagtgcaggttaaagtgctggccgactccctgcacgtgggccccagcgcgcggcccccgccgagcctgagcctgcgggagggggagcccttcgagctgcgctgcaccgccgcctccgcctcgccgctgcacacgcacctggcgctgctgtgggaggtgcaccgcggcccggccaggcggagcgtcctcgccctgacccacgagggcaggttccacccgggcctggggtacgagcagcgctaccacagtggggacgtgcgcctcgacaccgtgggcagcgacgcctaccgcctctcagtgtcccgggctctgtctgccgaccagggctcctacaggtgtatcgtcagcgagtggatcgccgagcagggcaactggcaggaaatccaagaaaaggccgtggaagttgccaccgtggtgatccagccatcagttctgcgagcagctgtgcccaagaatgtgtctgtggctgaaggaaaggaactggacctgacctgtaacatcacaacagaccgagccgatgacgtccggcccgaggtgacgtggtccttcagcaggatgcctgacagcaccctacctggctcccgcgtgttggcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctagaaccagactaccaggtgtacctgaatgcttccaaggtccccgggtttgcggatgaccccacagagctggcatgccgggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaagattccgtgcttgtggtgaaggcgaggcagccaaagcctttctttgctgccggaaatacatttgagatgacttgcaaagtatcttccaagaatattaagtcgccacgctactctgttctcatcatggctgagaagcctgtcggcgacctctccagtcccaatgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtaattcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcagccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaggagcagaagagggatcccacgaagttattcttacgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattgaa

SEQ ID NO: 23970 - DNA, 5600 bp, Homo sapiens
tctggagcagccggagctggaagaggaggaggaggagaggcggcggggaaggaggaggagggggagcccttcgagctgcgctgcaccgccgcctccgcctcgccgctgcacacgcacctggcgctgctgtgggaggtgcaccgcggcccggccaggcggagcgtcctcgccctgacccacgagggcaggttccacccgggcctggggtacgagcagcgctaccacagtggggacgtgcgcctcgacaccgtgggcagcgacgcctaccgcctctcagtgtcccgggctctgtctgccgaccagggctcctacaggtgtatcgtcagcgagtggatcgccgagcagggcaactggcaggaaatccaagaaaaggccgtggaagttgccaccgtggtgatccagccatcagttctgcgagcagctgtgcccaagaatgtgtctgtggctgaaggaaaggaactggacctgacctgtaacatcacaacagaccgagccgatgacgtccggcccgaggtgacgtggtccttcagcaggatgcctgacagcaccctacctggctcccgcgtgttggcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctagaaccagactaccaggtgtacctgaatgcttccaaggtccccgggtttgcggatgaccccacagagctggcatgccgggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaagattccgtgcttgtggtgaaggcgaggcagccaaagcctttctttgctgccggaaatacatttgagatgacttgcaaagtatcttccaagaatattaagtcgccacgctactctgttctcatcatggctgagaagcctgtcggcgacctctccagtcccaatgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtaattcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcagccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaggagcagaagagggatcccacgaagttattcttacgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaattt

SEQ ID NO: 23971 - DNA, 2085 bp, Homo sapiens
aagctgacacacagaccgacacaggcagcgagagacacgaggagcaaagcaagtgaaggcacagacgcacgggacaggagagcctgggcaagactggagagcccagacctgggatggcggattcgtgcaggaacctcacctacgtgcggggctcggtggggccggccaccagcaccctgatgttcgtggccggtgtggtgggcaacgggctggccctgggcatcctgagcgcacggcgaccggcgcgcccctcggccttcgcggtgctggtgaccggactggcggccaccgacctgctgggcaccagcttcctgagcccggccgtgttcgtggcctatgcgcgcaacagctccctgctgggcctggcccgaggcggccccgccctgtgcgatgccttcgccttcgccatgaccttcttcggcctggcgtccatgctcatcctctttgccatggccgtggagcgctgcctggcgctgagccacccctacctctacgcgcagctggacgggccccgctgcgcccgcctggcgctgccagccatctacgccttctgcgtcctcttctgcgcgctgcccctgctgggcctgggccaacaccagcagtactgccccggcagctggtgcttcctccgcatgcgctgggcccagccgggcggcgccgccttctcgctggcctacgccggcctggtggccctgctggtggctgccatcttcctctgcaacggctcggtcaccctcagcctctgccgcatgtaccgccagcagaagcgccaccagggctctctgggtccacggccgcgcaccggagaggacgaggtggaccacctgatcctgctggccctcatgacagtggtcatggccgtgtgctccctgcctctcacgatccgctgcttcacccaggctgtcgcccctgacagcagcagtgagatgggggacctccttgccttccgcttctacgccttcaaccccatcctggacccctgggtcttcatccttttccgcaaggctgtcttccagcgactcaagctctgggtctgctgcctgtgcctcgggcctgcccacggagactcgcagacacccctttcccagctcgcctcagggaggagggacccaagggccccctctgctcctgtgggaaaggaggggagctgcgtgcctttgtcggcttggggcgaggggcaggtggagcccttgcctcccacacagcagtccagcggcagcgccgtgggaacgtcgtccaaagcagaagccagcgtcgcctgctccctctgctgacatttcaagctgaccctgtgatctctgccctgtcttcgggcgacaggagccagaaaatcagggacatggctgatggctgcggatgctggaaccttggcccccaaactctggggccgatcagctgctgtttctcctgcggcagggcagtcgctgctggctctgggaagagagtgagggacagaggaaacgtttatcctggagtgcagaaagaatggttctctcaaaataaccagtggcctggccgacctgctctggccctggattccccatccatctcattgtctaaatatttagaaggcggagaagttcccagaggcttctgtacagtcaggtctgctctggtctgggtgctggctccaatctgcgtccacttaggaggcccaactgcccaccccaagtccccaggggatggccctccccctctaccaagccactccaagagccagcccctttctgctccacaaaaaccacagttattggaaaagctccctgccttcccttgccgctggtcccccaccaggcttgggagccctggcatcccaaaggggcaacgggaggaaggggaggctgctgcattgtgggtgatgacgtaggacatgtgcttggtacaaaaagggcctgagacattccacctagcttgactggctgcaagatgagaactgggggggtgcaggtggtggggagacagatggagaagctggcagatgaagggtgggggctgcggatcccagggactgccccagaacacaaacctaagtcctgtgcctgtccccagggtcctgaataaataaaagcctccttgcagagcctg

SEQ ID NO: 23972 - DNA, 1998 bp, Homo sapiens
gccagccccgccagccccgccagccccgcgatggcttgggccgcgctcctcggcctcctggccgcactgttgctgctgctgctactgagccgccgccgcacgcggcgacctggtgagcctcccctggacctgggcagcatcccctggttggggtatgccttggactttggaaaagatgctgccagcttcctcacgaggatgaaggagaagcacggtgacatctttactatactggttgggggcaggtatgtcaccgttctcctggacccacactcctacgacgcggtggtgtgggagcctcgcaccaggctcgacttccatgcctatgccatcttcctcatggagaggatttttgatgtgcagcttccacattacagccccagtgatgaaaaggccaggatgaaactgactcttctccacagagagctccaggcactcacagaagccatgtataccaacctccatgcagtgctgttgggcgatgctacagaagcaggcagtggctggcacgagatgggtctcctcgacttctcctacagcttcctgctcagagccggctacctgactctttacggaattgaggcgctgccacgcacccatgaaagccaggcccaggaccgcgtccactcagctgatgtcttccacacctttcgccagctcgaccggctgctccccaaactggcccgtggctccctgtcagtgggggacaaggaccacatgtgcagtgtcaaaagtcgcctgtggaagctgctatccccagccaggctggccaggcgggcccaccggagcaaatggctggagagttacctgctgcacctggaggagatgggtgtgtcagaggagatgcaggcacgggccctggtgctgcagctgtgggccacacaggggaatatgggtcccgctgccttctggctcctgctcttccttctcaagaatcctgaagccctggctgctgtccgcggagagctcgagagtatcctttggcaagcggagcagcctgtctcgcagacgaccactctcccacagaaggttctagacagcacacctgtgcttgatagcgtgctgagtgagagcctcaggcttacagctgcccccttcatcacccgcgaggttgtggtggacctggccatgcccatggcagacgggcgagaattcaacctgcgacgtggtgaccgcctcctcctcttccccttcctgagcccccagagagacccagaaatctacacagacccagaggtatttaaatacaaccgattcctgaaccctgacggatcagagaagaaagacttttacaaggatgggaaacggctgaagaattacaacatgccctggggggcggggcacaatcactgcctggggaggagttatgcggtcaacagcatcaaacaatttgtgttccttgtgctggtgcacttggacttggagctgatcaacgcagatgtggagatccctgagtttgacctcagcaggtacggcttcggtctgatgcagccggaacacgacgtgcccgtccgctaccgcatccgcccatgacacagggagcagatggatccacgtgctcgcctctgcccagcctgccccagcctgccccagcctcccagctttctgtgtgcacagttggcccgggtgcaggtgctagcattaccacttccctgcttttctcccagaaggctgggtccaggggagggaaaagctaagagggtgaacaaagaaaagacattgaaagctctatggattatccactgcaaagttttctttccaaaatcaggctttgtctgctcccaattcacctcgttactctcacctcgtgatatccacaaatgctattcagataaggcagaactaggagtcttcactgctctgcccccaactcccggaggtgtcaccttcctagttcttatgagctagcatggcccgggccttatccagtcaaagcggatgctggccacagaaaggccactcaggatgtcctttgtgtccattgatgtcattcagcag

SEQ ID NO: 23973 - DNA, 2506 bp, Homo sapiens
gaccttaaatatatcgaggtggctaattgatgtataataatttacaaaattattcttctatgctacagagctacaattcaatttacagtagtaaatatgagggccttcttaaggaaccagaaatatgaggatatgcacaatattattcacattttacagatcagaaaattgaggcacagattaagtaacttcccaaggctaccaggcattctagctccagaaactgtgctcttaccattctgctacaaggtatttcgaaaaaaagaaaaagtaaaaagaagtcaaaaggcaacagagttcattgattattccatagaacagtcacaccatgcaattctcacacccttgcagacacacttgaccatgaaaggttcctcaatgaaatgttcctcattatcttcagaagccatattattcacattgactttgcagttaactcagaccctaggtctggaatgctgtcttctctacttatccaaaactatacatccacagatcatataaactctcagccctgctgcaaagcctttccagaaaaataaaaatggttgaaaaggcaattctgctaccaatgactgtttaagcccagccaagtaactgaaccattccaacttcaatttacttatgaaaagaatttgatgatgtaggaggttatttcaattctaaaatacaaacccatgttgatctttctcaatcttgaactcatagattattatctattatctcaatttagtttgttatttatcctagtgggccattaaaaactaccacatgtgtttctgtctctccattagtcaataactaaactaacgagcaattagtaagccatgtgccagatgctccgctaggcaccagagggataaaaacaatacttatagtataccactaattttcgcttagtaactagtgaaatgttcaagtcatgcctgagtcaagagttgaggagacattacaatgtgtaatggaaaccaaggaaagtgaaactttggataagtggggactagtgtatttatatatttaattgatttctgactctatcattggcctccaaacacagattgtgtttttctttggttttgttttcttcactatgggatcttctgtgcccagcacagtgcctgacacatagaaaacaatcaaatatttgctgaataaatgattaaaaaatcagagaactttcccattctgtttggatctatagaacatccagagtaagtgatgagggcctctgcatttatatgcgcttaaattaagattatgtgagaaaagtttaaagacacttagtagagtgattttgaaatatagtaaacacttggaaatggtggtgctttaaaaagatattaatagataatatgaaaatctccatctcaaaaataatgcataaactatttaaaggaaaatcacatctccaggctttcaatgtttgttcattactttttcatatatttttaccatctgctgaaggcagtcatatcaaagggtaaagaaagatgggaggaaaactcagtaagaattatattagtctgtttgcaaagtagaaaaagattctcatcactcaaccttatgagcaggaagagggaaggctgtttgagaaccatttacttagcagaaccacatattttagacacttccctgcattaactgcacaaacaatatgtttgcaaacttgttagatcaacctccaacaacgacacattcaggagttaaatatttttcatcaaacattggatttttccttaacgctagagattgctacaaatcttctgaagggtctcaatggcttcaggctaagaagagatttctccctgttataagcagcaagacaaattagccatttcactctcaaacttcactaatgatcacattctttccaaaaggaactctagaagaccaaatgccccgagttaagaacatcaaaactaaccatctgaagaaacttcccaagtgtaagactctgccattaaaacattaccgagaggggactcaaacagtctttcttcctttgtcgtgtttcttgctcccagaccaaggcactgacgacagtactgatacataatttaaaagcacactcccttccactttgtaataccagaactctaattggacaccctgaagcttaggactaccagccatacaaatagtaaactctgtccacgattcactcatctgtgtattttctatagatgtttactaggcgtttgttatataaaaataccccggccaggcacggtggctcacgcctgtaatcccagcactttgggaggtgggtggatcacctgaggtcgggagttcgagaccagcctgaccagcatggtggaacccccatctctactaaaaacacaaaaaattagccgggcgtggtggcacatgcctgtaatcccagctactcaggaggctgaggcggagaattgcttgaacccggaaggtggaggttgcggtgagctgagattgcactattgcactccagcctgggcaacaggagtaaaactcccccccacccaaaaaa

SEQ ID NO: 23974 - DNA, 1020 bp, Homo sapiens
atttgaggccatataaagtcacctgaggccctctccaccacagcccaccagtgaccacgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgctgccatccttgcgctgctccctgcactcggcctgctgctctggggacccggccagctctaggctctggggggccccgctgcagcccacactgggtgtggtgccccaggcctctgtgccactcctcacacacccggcccagtgggagcctgtcctggttcctgaggcacatcctaacgcaagtctgaccatgtatgtctgcgcccctgtcccccaccctgaccctcccatggccctctccaggactcccacccggcagatcggctctattgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccggtaaaggctgagatgaagtggactgagtagaactggaggacaggagtcgacgtgagttcctgggagtctccagagatggggcctggaggcctggaggaaggggccaggcctcacattcgtggggctccctgaatggcagcctcagcacagcgtaggcccttaataaacacctgttggataagcc

SEQ ID NO: 23975 - DNA, 4572 bp, Homo sapiens
ccagcctgagccacatccctgggcttgacttctccagaacaagcctcctggtctttctgggagagctctggcagcatcactgtgcctgtgcagggagagcgggaacccacttcctgcaccggctttctctgagttcttcaggatgaattcgctctggtctagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttgg

SEQ ID NO: 23976 - DNA, 4845 bp, Homo sapiens
ggaaagctagcggcagaggctcagccccggcggcagcgcgcgccccgctgccagcccattttccggacgccacccgcgggcactgccgacgcccccggggctgccgaggggaggccgggggggcgcagcggagcgcggtcccgcgcactgagccccgcggcgccccgggaacttggcggcgacccgagcccggcgagccggggcgcgcctcccccgccgcgcgcctcctgcatgcggggccccagctccgggcgccggccggagccccccccggccgcccccgagccccccgcgccccgcgccgcgccgccgcgccgtccatgcaccgcttgatgggggtcaacagcaccgccgccgccgccgccgggcagcccaatgtctcctgcacgtgcaactgcaaacgctctttgttccagagcatggagatcacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatgag

SEQ ID NO: 23977 - DNA, 4546 bp, Homo sapiens
acgcgagttcccgtctttcctggtcgtcctccttgggttcgggtgaaagcgcttgggggttcagtgggccatgatccccgagctgctggagaactgaaggcggacagtctcctgcgaaaccaggcaatggcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatgag

SEQ ID NO: 23978 - DNA, 800 bp, Homo sapiens
ttggaacgagggctgcgggcaccagtgagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggcc

SEQ ID NO: 23979 - DNA, 4519 bp, Homo sapiens
tggtcgtcctccttgggttcgggtgaaagcgcttgggggttcagtgggccatgatccccgagctgctggagaactgaaggcggacagtctcctgcgaaaccagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatgag

SEQ ID NO: 23980 - DNA, 859 bp, Homo sapiens
gcgcactgagccccgcggcgccccgggaacttggcggcgacccgagcccggcgagccggggcgcgcctcccccgccgcgcgcctcctgcatgcggggccccagctccgggcgccggccggagccccccccggccgcccccgagccccccgcgccccgcgccgcgccgccgcgccgtccatgcaccgcttgatgggggtcaacagcaccgccgccgccgccgccgggcagcccaatgtctcctgcacgtgcaactgcaaacgctctttgttccagagcatggagatcagttgtcatggattcccagtatgcaagtcgcatcagcatcaggagtggaagagtctctgctggtccttaaggtctccaggaggggccagttccatcactggctttgggagcatgaaagtgacaaatccagccatgaatttgcctgagtgtcagtggttaagaatacaaaaagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgg

SEQ ID NO: 23981 - DNA, 831 bp, Homo sapiens
ctctccaggcccctgccacctgtttgcacatgaccctctacacccgccatagcaatggagaccccgcctcctgctacagttaattaatccttcttttttgcttcacaataaaaatagcatggctcttctgattgtaaaaagtgatatacactccttatttaacgaaaaattcaaagaatttgataaatgacaggcgaaaagtcaaaatgcctgcaattccagcacatggagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcg

SEQ ID NO: 23982 - DNA, 424 bp, Homo sapiens
gcagagctggcccctgactcacagcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaagtcgcagacgaaggaggcggagctgccagacacggaggagagccatgaggtgctgccgccccaggtacagaccgcgatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtcatccca

SEQ ID NO: 23983 - DNA, 680 bp, Homo sapiens
agaccagaccaacagtaacaccaagggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaacgagcaaaagtcacctgcccaataaagcttgacaagaca

SEQ ID NO: 23984 - DNA, 723 bp, Homo sapiens
agaccagaccaacagtaacaccaagggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagagagtccctaggtgaccccctcaaccagaactttctttcccaaaaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaacgagcaaaagtcacctgcccaataaagcttgacaagac

SEQ ID NO: 23985 - DNA, 873 bp, Homo sapiens
tgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctccca

SEQ ID NO: 23986 - DNA, 800 bp, Homo sapiens
accaccatgaatccactcctgatccttacctttgtggcagctgctcttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggatgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaatagctaaagcccccagtatctcttcagtctctataccaataaagtgaccctgttctc

SEQ ID NO: 23987 - DNA, 714 bp, Homo sapiens
atgaatccactcctgatccttacctttgtggcagctgctcttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcccgcatccaggtgagactgggagagcacaacatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggatgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaatagctaa

SEQ ID NO: 23988 - DNA, 4809 bp, Homo sapiens
gctgcgtccgcgccttctcttttccggtcctctccgccggccggggctcggctgagctccagatttccccacccgcggccgccgccaggggacaggagccgaggcgcggcagggcaccagcggcgggaggcaaggttggggaggcgagggcggtccgcgtgcgggggcgggagggggctgggggattcgagggacgcggcagccccgcccccgccccctcctcttctccgctccaagcccgagaagctggggagcatggaccagaccccgcagcgctggcaccatgacgctcgcccgcttcgtgctagccctgatgttaggggcgctccccgaagtggtcggctttgattctgtcctcaatgattccctccaccacagccaccgccattcgccccctgcgggtccgcactacccctattaccttcccacccagcagcggcccccgaggacgcgtccgccgccgcctctcccgcgcttcccgcgccccccgcgggcgctccctgcccagcgcccgcacgccctccaggccgggcacacgccccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaacttttgtcggagccccgacggcgcgggcagaccctggtgtttctacggagacgcccgtggcaaggtggactggggctactgcgactgcagacacggatcagtacgacttcgtggcggcaaaaatgagtttgaaggcacagtggaagtatatgcaagtggagtttggggcactgtctgtagcagccactgggatgattctgatgcatcagtcatttgtcaccagctgcagctgggaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacaattgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctgtgatgatggatggactgataaggatgcagctgtgatctgtcgtcagcttggctacaagggtcctgccagagcaagaaccatggcttactttggagaaggaaaaggacccatccatgtggataatgtgaagtgcacaggaaatgagaggtccttggctgactgtatcaagcaagatattggaagacacaactgccgccacagtgaagatgcaggagttatttgtgattattttggcaagaaggcctcaggtaacagtaataaagagtccctctcatctgtttgtggcttgagattactgcaccgtcggcagaagcggatcattggtgggaaaaattctttaaggggtggttggccttggcaggtttccctccggctgaagtcatcccatggagatggcaggctcctctgcggggctacgctcctgagtagctgctgggtcctcacagcagcacactgtttcaagaggtatggcaacagcactaggagctatgctgttagggttggagattatcatactctggtaccagaggagtttgaggaagaaattggagttcaacagattgtgattcatcgggagtatcgacccgaccgcagtgattatgacatagccctggttagattacaaggaccagaagagcaatgtgccagattcagcagccatgttttgccagcctgtttaccactctggagagagaggccacagaaaacagcatccaactgttacataacaggatggggtgacacaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtataaactagcaaaatttgaaaggatttctggtaactaaatgccagctggacatacaacctattttatccaacacattaacatatctactatatttgcttttaacaagcacctcatcatagtccacgttccccgaccatgatgtaagagtgccacccactgacacttccctgtaactgacttatacctgcaggttttcccaagcccaacctgatacaatccaatcttaaaatatactagtcaaaatgctttcctggcctacacattgaaaagttctaatacatacagcagttataacatatgccaggcactgcattaggcagctttgcacatcactgacaatttgcaaaaggccagtaaatcttatggtagtagcccttgttttcaaatgggggaaaacaggcttgcctcaaagtgagaccagttggtgaaactgattccaaactccagaaaaaatgctgatttttttccccatggttctcctacctaaatgattggtttccctatggctatttctccaagagttaagggatagctgcttaactatgcacctttacagaacattcttagcagtaatgctcaaatttaaaaggcacactcaagatacttccatgtcatggatccttccccaggtcccagtagtataaatatagggaagaggttagcatgaacttacaaattgttttaagtaatcctcttgaatgccagtcattaaaggactttgcccttctacatcaaattacatccttttcacaaatccccatttctgtaataactggtgcaaacctaaaggtgctttatagttttactactttgcagatttgcaatgctgcatataatgcagaagagcattaaaaacttttgtaaaaactcatgattttgataaacttttaaagtagcgtttatatgtaaatagaactacacatggcacacacacttgcacaagggcttcagaaaaacgtgcaatataggtgagaaaaatgtctattgaaactttctcacaggctgcccttataattaaactagtgttggggcaagcaacatctgtttcaagtagatcagggactagcaaacctaaaaggcagcaagcagcctgcagtttgctcaatccttaagaatacatggttcatacaacatgcttttactatgtcttaagtgtgacttttgaaagatacaagtgttctgtgcatatttgtgtaaataaatacataattttccaccttgta

SEQ ID NO: 23989 - DNA, 2716 bp, Homo sapiens
agagtcccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacgtggtatcccgaagcctaatgagcaccgcgatcggcgggtccctggagtgccgggcggcggtgtccgtcgccttcgctgaagtggagcggcggctgcgctcgggtggggcggctcaagcagcattgcggacggagctgagcgcttgcgggcccctgggccgcgctgaaaaccaggcggagctgttgggggcgctgcaggcactggtgggaggtgtagtgcagtatgatgggcagacgggagcgccgctaagcgtgcgacagctctgcggacttctcctcgggggcgggggcaaccgcagccactccacgccctactgcgggcttcgtcgggcggtgcagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgca

SEQ ID NO: 23990 - DNA, 834 bp, Homo sapiens
agagtcccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatataacc

SEQ ID NO: 23991 - DNA, 1019 bp, Homo sapiens
agagtcccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctga

SEQ ID NO: 23992 - DNA, 492 bp, Homo sapiens
agtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcac

SEQ ID NO: 23993 - DNA, 1101 bp, Homo sapiens
gagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaa

SEQ ID NO: 23994 - DNA, 1119 bp, Homo sapiens
gctgggagtagagggcagagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatgggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttc

SEQ ID NO: 23995 - DNA, 1159 bp, Homo sapiens
gctgggagtagagggcagagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaa

SEQ ID NO: 23996 - DNA, 1386 bp, Homo sapiens
acacaccctgacccgcatcgccctgggtctctcgagcctgctgcctgctcccccgccccaccagccatggtggtttctggagcgcccccagccctgggtgggggctgtctcggcaccttcacctccctgctgctgctggcgtcgacagccatcctcaatgcggccaggatacctgttcccccagcctgtgggaagccccagcagctgaaccgggttgtgggcggcgaggacagcactgacagcgagtggccctggatcgtgagcatccagaagaatgggacccaccactgcgcaggttctctgctcaccagccgctgggtgatcactgctgcccactgtttcaaggacaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccacatctggatctggatctgcggcggcctcgggcggtttcccccgccgtaaataggctcatctacctctacctctgggggcccggacggctgctgcggaaaggaaaccccctccccgacccgcccgacggcctcaggccccgcctccaaggcatcaggccccgcccaacggcctcatgtccccgcccccacgacttccggccccgccccgggccccagcgcttttgtgtatataaatgttaatgatttttataggtatttgtaaccctgcccacatatcttatttattcctccaatttcaataaattatttattctccagtg

SEQ ID NO: 23997 - DNA, 922 bp, Homo sapiens
ggcgcgggatgcagacggctgcgaggcgctgggcacaggttgccaggacaaccgtgaggctgcataaaaagaacctatgacaggatgcacatgagagagacaagtggcttcacattgaagaaggggaggagtgcgccattggttttccatcctccagatgcactgattgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctcac

SEQ ID NO: 23998 - DNA, 966 bp, Homo sapiens
atgtgcggacctgacgacagatgccccgcacgctggccgggaccgggaagggcggtcaagtgtggaaagggtctggcggctgccaggcctggcagagtggagcggggcggggcgcagcggggcggggcgggcctggagctgcacccgcttctgggtggacgcacttggcgagcggcgcgggatgcagacggctgcgaggcgctgggcacagttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctca

SEQ ID NO: 23999 - DNA, 834 bp, Homo sapiens
gacaggccttccaccaccagtcaggcacactctaccaccatgaatccattcctgatccttgcctttgtgggagctgctgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctca

SEQ ID NO: 24000 - DNA, 786 bp, Homo sapiens
ggttccgactcgcatgggacctgcgggggaggttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctc

SEQ ID NO: 24001 - DNA, 623 bp, Homo sapiens
ggcgcgggatgcagacggctgcgaggcgctgggcacaggttgccaggacaaccgtgaggctgcataaaaagaacctatgacaggatgcacatgagagagacaagtggcttcacattgaagaaggggaggagtgcgccattggttttccatcctccagatgcactgattgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgct

SEQ ID NO: 24002 - DNA, 1694 bp, Homo sapiens
ggagctgaggacagacagaaggaccacggagggggtgacgggctggtgtgaggattggtgcccctgggccaggactctcctctcttctccctgctggctccagaccagagtccaagccctaggcagtgccacccttacccagcccagccttgaagacagaatgagaggggtttcctgtctccaggtcctgctccttctggtgctgggagctgctgggactcagggaaggaagtctgcagcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccagggtgattctgggggacctctgacctgcctgcagtctgggagctgggtcctggtgggcgtggtgagctggggcaagggttgtgccctgcccaaccgtccaggggtctacaccagtgtggccacatatagcccctggattcaggctcgcgtcagcttctaatgctagccggtgaggctgacctggagccagctgctggggtccctcagcctcctggttcatccaggcacctgcctataccccacatcccttctgcctcgaggccaagatgcctaaaaaagctaaaggccaccccaccccccacccaccacctcctgcctcctctcctctttggggatcaccagctctgactccaccaaccctcatccaggaatctgccatgagtcccagggagtcacactccccactcccttcctggcttgtatttacttttcttggccctggccagggctgggcgcaaggcacgcagtgatgggcaaaccaattgctgcccatctggcctgtgtgcccatctttttctggagaaagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagccactcctgacctacaaagttgtgacttaataaatgtgtgctttaagctgc

SEQ ID NO: 24003 - DNA, 1940 bp, Homo sapiens
gactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcacaa

SEQ ID NO: 24004 - DNA, 504 bp, Homo sapiens
atggcccagaagggggtcctggggcctgggcagctgggggctgtggccattctgctctatcttggattactccggtcggggacaggtaaggaaggggccgcagctccctgcggtgtggccccccaagcacgcatcacaggtggcagcagtgcagtcgccggtcagtggccctggcaggtcagcatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggagggggctctcctcagggtgactctgggggcccactctcctgccctgtggagggtctctggtacctga

SEQ ID NO: 24005 - DNA, 1552 bp, Homo sapiens
ggatgccggcggtctctgctgaagagagaagatggcgcttgacggaccagagcagcgccgccctcggtgagtcagggcaaggctgggagaggaagacgcggtagaagcggagtgagtgagggaagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtc

SEQ ID NO: 24006 - DNA, 998 bp, Homo sapiens
agtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactga

SEQ ID NO: 24007 - DNA, 1641 bp, Homo sapiens
tggttcctatcagcttccgtagcgtccctaacgacttccgcctctggcgggccgcagtggtggaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaa

SEQ ID NO: 24008 - DNA, 1389 bp, Homo sapiens
gctcaagtggccaaggcaagatgggtcaaagtcagagtggtggtcatggtcctggaggtggcaagaaggatgacaagtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtg

SEQ ID NO: 24009 - DNA, 1526 bp, Homo sapiens
gaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctagaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgtt

SEQ ID NO: 24010 - DNA, 656 bp, Homo sapiens
ctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcac

SEQ ID NO: 24011 - DNA, 3054 bp, Homo sapiens
agttttcctgtaaaaaggattatattccacgtcccagtgcaatacatagaacataacctttaaaagcagttctttttatattatctttaagttcttactgctttatgtattaatctgaacctaatcagtgattttcccaggagcgctatacttttaagtaaaaaatgaaaatacctgtatgaaccagtatcgacgactagtatatacatttgcggagaattacgtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctagaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacaca

SEQ ID NO: 24012 - DNA, 682 bp, Homo sapiens
atgagaacctttctggggtgctggggggttccgtcccgaaatgctcagcccaatccatgagtcagcagcggcgagaggaggaagcaacgtttccttctcacaggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcac

SEQ ID NO: 24013 - DNA, 1415 bp, Homo sapiens
gaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctagaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcaga

SEQ ID NO: 24014 - DNA, 1544 bp, Homo sapiens
attcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtccctgcc

SEQ ID NO: 24015 - DNA, 1433 bp, Homo sapiens
gatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccattt

SEQ ID NO: 24016 - DNA, 1340 bp, Homo sapiens
gatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccattt

SEQ ID NO: 24017 - DNA, 1319 bp, Homo sapiens
aagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctagg

SEQ ID NO: 24018 - DNA, 1449 bp, Homo sapiens
agaagcggagtgagtgagggaagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagt

SEQ ID NO: 24019 - DNA, 2188 bp, Homo sapiens
acggccatggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggtaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctcctacatatatattcttgtcttttctgagtatatttactgtggtcctttaggttctttagcaagtaaactatttgataacccagatggattgtggatttttgaatattattttaaaatagtacacatacttaatgttcataagatcatcttcttaaataaaacatggatgtgtgggtatgtctgtactcctcctttcagaaagtgtttacatattcttcatctactgtgattaagctcattgttggttaattgaaaatatacatgcacatccataactttttaaagagtatgattcaacgtaatatttgctaatatgtgactgggttttcttggtttatgtaagacgataggtccctgttgaggatgtggaggtctggaccctcttccaggaaaaattctaacatacaattttgcgtatactataatttcaggaaatttattgtttcccaagctcatccaaggactctttaggtatgtatggatacctggctaagagtgtatgatgtaggggatgtaggagtgtcagaaatgttcaaaacatgatttctgttacctatacatgattcttatatcatctggcaataaaagctataacaaa

SEQ ID NO: 24020 - DNA, 1954 bp, Homo sapiens
agataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagacagagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtcta

SEQ ID NO: 24021 - DNA, 577 bp, Homo sapiens
ttcaggtaagacccagaaggcaggcctgggaggtctggggaggcagccgtgctaggccgccgccagccccgtgctttcctgagtcacgttgcccagctgagttgccacaggaggcctgggccgcgagggaggagcccggcctccttcattctcttcgcctgctctcagggctctctggcagggtcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtgg

SEQ ID NO: 24022 - DNA, 3449 bp, Homo sapiens
caacaacaacaacaaaaccaaatgaggttaatattccacagtggtgtggggctagacacagttacacagactttatacaggcggcaatcaagcgtcctggacgtcaagaaatctagtttgtctgtcgcgccacgcagtcaactggagtgtcactgtgggttctatttacaccgttatgagaaaaacctgtggcggagtaaaactcggtaactccgctcgcagaccgcccatctacagcagtgagcgaacccaaaccccacacggccaagtcccgcgggtttcaggaaactccgaagaggtcgggggccaggggcgactatggcgcgggggaggctgggaattgtagtctccacctgcctccgagggcggggtccgagggcggggctctcaggccgagggggtgggtgggtcgccgagcgccccggctcgccccggcgtttccggtcgcaggcgggctctggaggaggaggggcgccgcgaccgacgcgcgcgagttggtctgggaaaaagggcggtgcgagcgggtgcgcgcgcagcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaggtc

SEQ ID NO: 24023 - DNA, 2877 bp, Homo sapiens
gcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaactgatgctacaaaacccacctagagaacaacaggtttgggggcagtggctctcaggtggactctgcccgcatgaacctggcctcctcttttgtgaatggctttgtgaatgcagcttttgggacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggcccttattgctatgggggaggagattggtgcagagatggcattacgaaccttatcatcagctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatcccc

SEQ ID NO: 24024 - DNA, 2861 bp, Homo sapiens
atggaggagggaggccgggacaaggcgccggtgcagccccagcagtctccagcggcggcccccggcggcacggacgagaagccgagcggcaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatcccc

SEQ ID NO: 24025 - DNA, 3371 bp, Homo sapiens
aagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcatggaatgtcagatgttactttgttaccaacactgttatatttctacattgaaatgcaaagtggaactaggagtttggaatgcattaagagcagacaagcttggtcataatagatccagtgtttttcagattcctttcactgccttaatctttgcaacagggtggaagtttttttcttccctcaaaattttcatggacatgcaatcttatctaaaagcctgcttcagggctgggcgcggtggctaacacctataattcccagcactttgggaggccaagatgggcaaatcacttgagtctaggagttcaagaccagcctggccaatatggcaaaaccctgtctctactaaaaatataaaatcagccaggcatggtggcgcacacctataatctcagctactcaggaggctgaggcacgagaatcgcttgagcctgggaggcagaggttgcagtgagctgagatcttgccactgcacaccagcctgggcaacacagcaagactctgtctcaaaaataaatgaataaaataaaaacctgccaccaaattatttctggattctcttcactatctttttttttctttttggtcctttttccatttctgattccactttcaaagtcttggatatattctttgaaaaatgagtagtatggaatattaagattatgttccttatactcagaatactttttatgagctctcttgtttttttgttactattattcctttgaaaaaaagacaaaatatctaaaaaatgtttatagtgttcatgtaattttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcataactattttaagtgtacagttcagtatattacatatgttcataagttgtacaaccatcaccaccatccatcttcagaattattttcatcttatacaattgaaactgtattcattaaacaataactgtctattccctcttttccccagcctctggcaaccaccattctgcttcatgacattgattttattcacttaacatcagattttggggggatgccctctctcctatgtatggtctacacattctgattttttttttagattgaataaaatttgtaaatcattattttcatttcataagtaaa

SEQ ID NO: 24026 - DNA, 686 bp, Homo sapiens
gaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggttggtatgacttggccctgttcagggatatcttaatctttgacaggggttcaatatgtaagttcatttgctggtgggttaactacattgtagaaactattttatgggtggcagtcttgttaaccatgaccttgtactcatgtctgaaaatctaataattattacggaaaacctttttttttttttttttgacttttcactggtttaggttttcattggtttaggtttctaccaatcgatttcaaccaaacattgtttcctgtttcccctctatgatgtcttctttgactagatttcatggtacaaagaccacgggctagagtcagaaaggtctggattcatgtccttgggttttctattcttt

SEQ ID NO: 24027 - DNA, 1538 bp, Homo sapiens
gggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcgctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcat

SEQ ID NO: 24028 - DNA, 546 bp, Homo sapiens
aggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacgggaaggaaacacctgcatcttgaagaactagtaggaggcaatcaagtgaagaatacagtggagtagcaaagcaagacagcaggtacacatgaaaacaagagaacatgtttgagaaactacaagtaattcaatatgaccaacgcctaggatttaaagggaaatttttgcaaaattctttatcattattactaataatagctaccatttcttagcattgattttatgttaggcacttggcatgcatttcttactttatcatcataatagccataaaagttacgtatcatttcaca

SEQ ID NO: 24029 - DNA, 5689 bp, Homo sapiens
gggagcggaagaaggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgatttttaagctgtgttctagtcgtttttgacttcgggagtagtgatctgtagtttccagaagcagccaagacagtcttcgattggagctgccttaagttctcttgcacttggtatcatttatgaaagagcatctcattcccctaaatggaaacaggcagtctgctgtagtgaggagagttctctgagcccagaagacccgggttccagtttgtacctcagatccctcatttatgaggtggtaggttgcagtccgtcatctctgaagtccccagaacagtgtttcaaaagggacacatttaccacactgcagcaagttgtaagtacctcagaccacaggccaaacaggcatgttactaagaatggaacaatgtttcccccaagataagtgcacaggactcctagaggaacaaattaaataaggcactaaatcatttgacatacagtagtcacggatattaaatttcctctcttgaacagatagaacctctcaaatgcactacgtggattattcatcttcaaagatataagaatacaataaaatagcacaaaaactcagttgcatctcagaaaccacttcatgaggttataatgccttaaagtaatcagaagcatcgatttttattccatagacctgccaaagagctagttagtgggaatttgggaataggtagagcttgagtatcccttatctgaaatgcttggaaccagaagtattaaaagatttaggaaatttttttttttaatatttgcattatgcttaacggctgagcatgcctaataggaaatgttccaatgagcatttcctttcaataccatgtaagtgctcaaaaagtttcagattttggagcatttcaaatttttggattaggggcactcaacctgtagtaaaatgtaaaatggctcttattcagcataaatagaggcatgcccccatcaggggtcatttcagagttcatcaagattctgagataaaaaagcatggtacagtgaaaacaacaaaattgactttcctgtttcagaagccaaaagtcagacggtttgtatctaattgaataaaagaaacttgaagtacgtaagttaaaacttgaggtgtatcccaaaccatgggagcgttgaagaagcttttgagatctgggtgccatgtttggaacacactgatgtgacaggttgcctggaccacaaaccctggctaggaaatgggcaagagcaagacccaggcatcgggggagagccaggtgccatggtgctgaggctctaagcaagggaacgcaacgtcatcctaaggaacgggtcctgtatgtaaggctcaggggccagtgcacacctgaattgacaccgcacaggattcaggtctgcctttaagaacataatgcagggttgggggcagtggctggtgcttgtagtcccaacactgggaggctgaggcaggaggatcacttgaggccaggagtaagagaccagcctgaacaacatagtaagagccatctacaaaaaattctaaaattgcctgggtgtggtgggatgtgccttagtcctagctactgaagaggctgaggtaggacactggagcccaggagctcaaggttacagtgagctgtgatcacatgccactgcactccagcctaggcaacagagcaaaatcctgtctctttaaaaaacaaaaagtatcatttggatttaaaagactttcccagggtccagtgaactagcacaatgccacagacttgtaagttggtcatagtttgatgaactgaaatgtttattgagcatctaagaacataggaatccccaggccttattatttttaatagtttggcccacatacggacaaaactgacttctaccttcctaacagaaatcttccatttctacttatgaagaaaatagcttatagcctgtggagtcacttaggcatattttctaaggccaaattgctgccatcatgtagaagagggggagcccagtagtgctaccgatgaagtcttgctcatacaaatagcggctgacttgactgcaaaacccagggcccacccctaaaataaagccttacatttgtgtattctggcattctggagatgagacttctaaacggcttttgctggctttggaaacactaaaaaagtattctggaaaaagtgtgatcctcagcctggatctcatcttcctagctgcaacattagcttcccttcgatttcaccacagcttcagaatgactgcctaatggatttcaggctgctcctgtgacaccttacagaggatgctgttcactcctgaattacggttttctgtttgaaaacacgaaatatgcgagttatagactggggataaatgtggagagggtcctgaagtcaaggagaagattttaccaaaactagagcacttcaatggagaagtaggcggagtgtggtggctcatgcctgtaatcctagcactttgggaggtcgaggctggtggattacttgaggtcaggagttcaagaccagcctggccaacatggtaaaaccccatctctactaaaaatacaaaaattagctgggcgtggtggtgtgcacctgtaatcccagctacctgggaggttgaggcaggagaatcgcttgaactggggatgtggaagttgcagtgagccgagattgtgccactgcactccagcctgggcaacagagcgagactctgtctcaaaaaaaaaaaaaaaaaaaattgccagaagcagatgaaagacaaccacaggtttaaatgaaaacaagctgaaacaatgcaaactttttatactagatattcgacttaaaaatatctcaatgaagggttagttttctcaaaaaaaaatgaaaaagaaaacaggaaatagccctcaacttatggaaaagaatgaaatctcccattcactgggtagttatgcaaaggctttttcttctaccattttccattaagcagaataaaacttgagaatgagttaggattgtttgttagactataacatgctaacaaaaccactttcatctgccctgtctgggaaaatgcggtggatacaggacatgtgggaaggcagagaaacatttgatttatatggcccacaagagaaaatgtttacaacttccctaagcaaatgtactgcaaattattacacataatacctgtgtacattcctatgccattcaactcttggcattaccgatttttgcctggtagcagtgcaaaattgagatctttttttaaaaactaaagcctgttttttggccaggcacagtggctcacacctgtaattgggaggccgaggcgggcggatcacacggttaggagttcgagaccagcctggccaatatggagaaacaccatctctactaaaaatacaacaattagctgggcatggtgatgggagcctgtaatcccagctactcgggaggctgaggcaggagaattgcttgaacccgggaggcggaggttgcactgagctggagatcgtgccactgcactccagcctgggtaacagagcaagactccatctcaaaaaaaaaaaagtaaaggctgtttttattgggggaataattaagaattgactcagtatagacatggaagtgaggaaagaaaatatgtgaaaagaaaggaagaagaaattatggaagtcgtgtttctagggcccaaatcaagagaaatcttttgctaatcattgctctttggagccaacctgttcttcgacactagatggcgtcattcactcacctcagctcatctcttggcaagagaaaaatttgattcccagttgggcatagatttgggaatctcccccaattacttcctgccatttctgctttcagctgaagccacccaggcaaaattttgaaggaacttgaagaggctatgggtgcaaaaagactgggttaagcatccacacctccacccttactgtcctcttgcacactgctgctgggggatgaatacattaatacaagcagatagtatgtgcttcgatttcccttactgctggtattactcttctaattttttttttttcctcgagactgggtcttg

SEQ ID NO: 24030 - DNA, 1395 bp, Homo sapiens
agaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgggtttcgccatgttgcccacgctgcccatgctcgtctcaaactcctgagctcaagtgatctgcccacctcagcctctcgaagtgctgggattacaggcatgagccactgcatccggcctactccatcatctttattccaaaaaagatttcaggatgggaaaagtttaaagaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgt

SEQ ID NO: 24031 - DNA, 741 bp, Homo sapiens
cgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgtcgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcgggtctgcaagtggatgatgagattgtggagttcggctctgtgaacacccagaacttccagtcactgcataacattggcagtgtggtgcagcacagtgagggggccctggcacccaccatcctactttctgtctctatgaatttgactactccagggacctcatctaggtga

SEQ ID NO: 24032 - DNA, 2784 bp, Homo sapiens
gactgttctcgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgtcgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcgggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatgaccctgttgtcaccccagctgaatttcttatgaccctcccaaaccaaagctcagatggggtcagaagagcttcatagaaagttgggcaaaacaggctagcaattgcaaagtcaggctttgaccaacatatttctttgcactgaggccttgctgctgtggatacggaaatggttaagtactgtgcttcctcagcagctgggctgtcagggccatagtagctccctttggagaacagggaaagcctggaggcttcccaggtggcccagcgtggtgtcctgtcagcttcctctttaggaacccaccagagggcagcaagctcctttcacttcgctagtaagaacccctccgtttttgtgtgtttttgtttttgttttctggagacaaggtcttgctttgtcacccaggctggagtgcagtgtcgtgatcaaggttcactgaagccttgacgctgtgggcactgcctcagccgcccaagtatctgggaccacaggcgtgcaccaccatgcatagctaatttattttttgtagagacagggtctccctgtgttgaccaggttggtctcgaactcctgggctcaagcagtcctcctgccttggcctcctaaagtgctgggatcacaggcgtgagccactgcgcccagcccactgctagtttgactttttataattgaacctcctggctatgccctgagatcagcgctattttgtaaaccgctgaggtatggataggaacgagtagatcagacctcttgaaaatgcttattcttcctcccttttattttttgtctcttttaagatggtaaaatggttctcagggattcctgccaatactttgaattattttttcctctccatggtatcagtgttcatttccccagttcttgcacaccgctttctgttttggcagttctgccaggcaagccctgtgttccttgggactggttttgctgtggttggatacagataccagcttgccttgatgggattggtattgctgtgtgcttccagccacaggttctcacactcaattccaaagccttcctattgggcgaattccctcaaactctatttgacctgacagccatacgtattcccctctggtagccacagacatgctgtgtttaccaatgtttgctgtttaaattgcatgttctaattccacgtatcttccagtctcttttataaagtctcagactataataaacacagcttgcccagtttatcctttcttttttattttaagatgtatgcatattaatcaatttaccatcactggggcatggcagtgtgggcggggagaattattcacattctcctaaaatgacagcagcagagagccttctgcctcagtggctctggctggtttcctgcaggggtcccagtggaaacccgtgtggccacctgttgccgtcttccatgagatgttagtggagagccactttgacgtggaatgatcctaatagatatagccagaccggttttgcggaaacgctttgtgctgagaaccgcaagctggtgcaccctgtgtcatatctgcccccagccagctggaattgtctgcaacacgcggtgcccggtgaggaggcaggcaggacggttgtgtgctgcatccatgagacctggaaattcagtttgcttttggaaaagagcattg

SEQ ID NO: 24033 - DNA, 1006 bp, Homo sapiens
actacccaggaaggcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgcccatca

SEQ ID NO: 24034 - DNA, 1136 bp, Homo sapiens
ttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgtgaggaggcaagggcagggcaggggtgggcagaggcagctttcccaggccacccactccctgaccctgcaggctaggggttaagggtgacaaagctcagcttctccacaaggctagaaatggggcacagagccactggaggcctctgactgacctctactccctggccctgtaggctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgccca

SEQ ID NO: 24035 - DNA, 1404 bp, Homo sapiens
ctggaccagtccggtacgctccgggcctcaccgaggaagtcccaccctgcaggggaaccgactctggccggccctaacccctctcgagcgagtcccgccccatctccggtctgtcctgaaggcagagggaagaccctcacccaacccctgcccgctctcttctaagagctgctagtccttctccaccccaggcgctccctctggctgcccctcccactcgctctgatctctctccgtccgctacttgcggtcgagccttcttgggggagccccgccactgaataccccctttgccatactcccacctctcttaccccaaccctggacttccagttggccctagctataagccccgcccctctccgagggacagcccccgctccagtctccgcggtcccacttaccctagcccctccctcgggcagcccctggactgtgacccagccagcaccgcctctcctagtggcaactggctgggaatggctgaggggctacctactgcttgcggcctgccagcgggaggaggggggcggaaagaagaaagggggcggggttgaggggggcgggcctggacctggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccataagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 24036 - DNA, 3210 bp, Homo sapiens
ggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacgccttcaggcaaaggtcctcatatatgttttgacctccaggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttgc

SEQ ID NO: 24037 - DNA, 3171 bp, Homo sapiens
ggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttgc

SEQ ID NO: 24038 - DNA, 2941 bp, Homo sapiens
gcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaagctctgagcttccgctcggctcagcccagcccccaactcccggggtcggcttcgcgggagaggaaaatataggatggctttctgtaccgcgtctgatgatggagagtcccggggacacctccgcggacacgtgttggactcagggctttaggcccgtgacagctgacagcttcagacacaggaggaagggagggaagggggaggacagaggagacaggcaggtgctgtcctcaaagccctgcgttcttctgagatggaaaaatggatcctcaaaaaaataaagtatttgcagtctgggggcctctcagcttcttattacagttacaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattatt

SEQ ID NO: 24039 - DNA, 956 bp, Homo sapiens
aagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctg

SEQ ID NO: 24040 - DNA, 3082 bp, Homo sapiens
aagtgtaggagccaaggccgcagagaatggggaggctccgctattctctaaattcagggggcggcgggcgcggtggctcacgcctgtaatctcagcacttggggaggccgaggagggcggatcacgtgaggtcaggagttcgagaccagcctggccaacacagtgaaaccccgtctctactaaaaatacaaaaactagccgggcgtggtggggcacgcctataatcccagcttaatcccagctactcgggaggctgaggcaggagaatcgcttgaacctgggaggtggaggttgcagtgagccgagatcgggccactgcactccagcctgggcgacagggcaaggctccatctcagaacaacaacagcaacaacaaaaggccgggcatggtggctcacgcttgtaattccagcactttgggaggccgaggcgggcggatcacaaggctggagtgaagcggaacaaacaaacatggctcactgcagatttgacttcctggctcaagcaatcctcttgcttcaacctccagtgtagcagggaccacagcatgaaagcccctttaggggaggtgactggaatcatccccaaagaattctcacctagtcctggtgtggctgcttcatagtcctgcgtttcttcctgcttggctgtccctaacatctcagaaacgcatagagaagtaacgggcttctagagaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttct

SEQ ID NO: 24041 - DNA, 7099 bp, Homo sapiens
ggtgggggccggggagggttcgggtgggagggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctgactggctgttttttccctgtattctttacaactattttttgaccctctgaaaattattatacttcacctaaatggaagactgctgtgtttgtggaaattttgtaattttttaatttattttattctctctccctttttattttgcctgcagaatcgttgagagactaataaggcttaatatttaattgatttgtttaatatgttatataaatgtaaaagagtgtataaactgtagagatagcattggcaagacattgtacagatgcaaccttttacacaacatcattgtgtaatttgtaaagattcacgtgtagttctttattatagtgattttgggctttgtacccactgaatgccattttttgtgtttttaaattattttctttatcttgttacaaaaactgagatgtggggttttttttttttcagttcacttatcattagaatgtctgaacttttatgtaacatttttgtgtgcatctctcaatgctaacaccacatgtttgcctatgacaagtttatagagtgaaaggtatcttctgggttgaaataattcacaaattggtgaatgtcatcttgcaacacaccctgtacagtcttccttaaaggaacactacagtatatttttagtatctacatgctgaatgactgaatacagacctaagcacagcagtggtcctggtacagtatttaagtgtcggcatacacaggcgtaatccctgtataaagtagtgccaaactgatttcagttgtgtaactagtttaaaacccaataaatggattctttttaaca

SEQ ID NO: 24042 - DNA, 4475 bp, Homo sapiens
atgggagaaaatttagcaaagaagatcatgttctttttattaactataaaattgatcctgaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctgactggctgttttttccctgtattctttacaactattttttgaccctctgaaaattattatacttcacctaaatggaagactgctgtgtttgtggaaattttgtaattttttaatttattttattctctctccctttttattttgcctgcagaatcgttgagagactaataaggcttaatatttaattgatttgtttaatatgttatataaatgtaaaagagtgtataaactgtagagatagcattggcaagacattgtacagatgcaaccttttacacaacatcattgtgtaatttgtaaagattcacgtgtagttctttattatagtgattttgggctttgtacccactgaatgccattttttgtgtttttaaattattttctttatcttgttacaaaaactgagatgtggggttttttttttttcagttcacttatcattagaatgtctgaacttttatgtaacatttttgtgtgcatctctcaatgctaacaccacatgtttgcctatgacaagtttatagagtgaaaggtatcttctgggttgaaataattcacaaattggtgaatgtcatcttgcaacacaccctgtacagtcttccttaaaggaacactacagtatatttttagtatctacatgctgaatgactgaatacagacctaagcacagcagtggtcctggtacagtatttaagtgtcggcatacacaggcgtaatccctgtataaagtagtgccaaactgatttcagttgtgtaactagtttaaaacccaataaatggattctttttaaca

SEQ ID NO: 24043 - DNA, 2154 bp, Homo sapiens
ccacctcctggcgcccgcagggctcaagctgcgaatgaaagcctttgggggccggacgcggtggctgaggcctgtaatccaagcactttgggaggtctaaggaggacgatcgctagagtcctggagttcgagaccagtctgggcaacatagcgagaccccctcccccaatctgtaatttaaaaacaaaaaagctgcggggactgctggcccagggcatgacagcgcgggcgggcggtgtagagggcgtggccgcgagctcagggtgtgcctgggagcgagccctgtgcggggcgggacgtagcgcccgcgcggtgggggtgtggccgcgagcttgggctgtgcgcggagggcgtggcctgtgcggggcgggacttattgcccgcgcggtgagggagcgtggtctcgcgcaagccggcgtgcggtcccgcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcggtttttctctgtcagtgcagttgctatgttgcagaagatcaacagtatcagtggctggaaaaggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatgatcttaaacattgttttgtagtgtatattacttgtccattcctttaaggggagcagcctgcactcttttgtagattacttttgggggatatattttgagaatgatgaaacggaataaaattgtaaaaaattaattgtagttttaattccttatttatggtggtattattcacaaccaaaataagccaagcattttccttttatccactaggtgggagtattgttgtatttgaatattttaaggtactatagttaaatttttatcttatttatttatttatttattttttgaggctgggtcttgctctgttgcccaggctgaagtgcagtgtgctatcatggttcactgcatcctcgacctcctgggctcaagcatttcccccgcctcggcctcccaaaatgctgggattacaggtgtgagccactgtgcccaactttagttaaatttttcaaagctacagatatcagcagatggtattcatgtggcaaagtgtagttaattaggtgtaactattcattgacctgttggtgattcttaatatgtggaaagtttctggatattttaggagtcctgcagttttttttatcttgtgggtaaaaattgatgacaaagtaacaaaattatatatttactaaaaatgaaacagaaatgtgtatgtcctcactttttagtaatatctgacagatagcctcttcacccagactttcccagggctctctttcaaggctggctctgcgcgtgtcagcagttctcttacagtcatgtgttatcattaggagtgtgaatggaatcatgaacccggagtagccacacaacttcaca

SEQ ID NO: 24044 - DNA, 907 bp, Homo sapiens
ggggcgggacttattgcccgcgcggtgagggagcgtggtctcgcgcaagccggcgtgcggtcccgcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatga

SEQ ID NO: 24045 - DNA, 1686 bp, Homo sapiens
ggcaggagggaaaggttatgggtcggcccggcggtctctcccagcacccgcgactctcaccttgctcagctgctggtggatgagctgcttcagctcggaggctttctccggaggcagcgacatgctggcagccggcgtctccccgccgcttctccccgcctcagatgccctaactgcgcggccccggccgggccagggagcgttaggagcgactggagcacaaagcgccgcagccgttcgcctagcgcagctcccgggggacgcaacgccgcgtcaggccgggggctgacctggaaatgaggccccggcggcggcggcgccaactgttttcaaacagtggcggacaaacagggcttggggctggcccgcacgctgcctgatcgtttccgcccgccgctccacctccccgcgggccccgcaccccgagacctcagcgcaccccatcgccttgcttgccagggtctccgaaagcgctgctggcccctcttcgcggccacccggcggcctctttccgccctctgaaccggcagttagctggacgggcctcaagggcccggcgcccagggactcaaaggaccctcccgcgccccgcgaggctccggggtctcgggcttccgccttcttgctgccctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 24046 - DNA, 1050 bp, Homo sapiens
ctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagt

SEQ ID NO: 24047 - DNA, 1107 bp, Homo sapiens
atgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggt

SEQ ID NO: 24048 - DNA, 1505 bp, Homo sapiens
agtatcacccagagtcacggctgttgactcggacgactttagatgcagcccgccagcgggagaaactggagggaatccgccatacacaggaacctagaagggctacgtgacaggggctgccccgcagctctcagccgccggcactcccagccaggttttcccgccagtctcagttcctagatcttccgaggctccgcccgccgccgagcggtcggaaagttttaaggagggggaagtgttgcaagcctatcgatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggta

SEQ ID NO: 24049 - DNA, 1266 bp, Homo sapiens
cgcgagccgggaccacgccgacccagcgtgcccaggccgaggaaagcgcggcggcggcagtccgaagacccaccgggactgaaagagaaggacgaggtcatcttcggacgggaggggcaagccagccatcctgggaccccaggcgtgcaggttctctttgagggtattccaccctgcaaaaagcatgtattcatggtcagctctcagcaaggccagtagcagagtggtaaaggccttggccctccaaggctgggaaaagacaatgacaagtcaaatccagacctatgttgtatgttggtctactaggtgactgtctcctggaaatgttatgcagctcagcaaggtgaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtc

SEQ ID NO: 24050 - DNA, 1221 bp, Homo sapiens
attctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcagtatcctttttatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcg

SEQ ID NO: 24051 - DNA, 1483 bp, Homo sapiens
ggaaatgaaaggaaatcggccacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaa

SEQ ID NO: 24052 - DNA, 4237 bp, Homo sapiens
ggctcttcgggtaaagatggcggagcgcgggtacagcttttcgctgactacattcagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaaggtaggcctactcattgtaactgcattctttagcaaactcactttatggtttttggtgctctttaagtaaattaatatcatgggactaaagaaacttgctatattactctgtatatgaatctagttacagataaaccaaaaacttctctcccttctagtttcctagacttcagtatattaagtggtaattaatattcatttcctaaggagttctctttctacattctatggtttcctaaatgcttttggtttttttactttttacttcactttttgtgccatttcaggagggaaaaaaaagaacattgaatctggaataaaacatttggggagacaaatttttaaatgatttaatgataacagtttacgacagtaaaaaaaattgtgaaaccaaatgcctggagttgaaggtatattaaatatttgatacatgtgcttgataaaaagtggagcactatgtaaaaatctgtcggtgcccaagtacaagctgctcttacttatttccagctgtattctagtctcagtgttactgtagtccttcgggactctccaagcttttgaagaagaaaatgttttatttcttgatatgtaatagttgcacatatttttgcagtacatgtgatattttgatacctgtatacagtgtcaaatcagggtaattggatatccattacctcaaacatctgtcttttctttgtgttgggaacatagcagatcttctagctgttctgaaatatacagtaaattgttaacgataatttcctgactgtactactggacaccagaacttattcctcctgtctgaccgtatttttagaccccttaaccaacttccttcagttcttcttcccttctcccttcccagcctctggtaaccactgtgctactctctccctccatgagatccacttttttagctcccacatatgagtgacaacatgcaatatttatctttctgtgcctggcttattttgcttaacgtaatgacctcgagttccatccatgttgctgcaaatgacaggatttcatttttttatggctgaataataataaaaaacttcgtaactccgtttaacagatgagccttcacagtacatttttcacgtaacgttaaggttattaaaaatcttaggcctggatttaaatggtaaacttaatcttaggctcttaaagcactttttcatttttcttttatatattaatgagtcttccaaagatttcacattgttattacatgatatgttatgatttgttttattttttgtttcagaggcattttatttagacaactaaaaataattagatgttcagaaccagtgtacaatgaaagaaattaaaccagttactttatcatgtattccctctttacaaccaaagcaaaaaacaatagcaacaaagacattctgctttaagggaaaagtcagacaaataagccaatatatttttcttctccataatgacataaacagctgcaagaactcttaattgtaataagagaagttggatgttatcttgtacatattcattaaaaagatgacaggccattgtactacaagaggataactcaacctcccttcatctgatactcttgagatttcacttatgggtaacaccatgttagttgtttcagcaatggagctaattcatattcctcattatttattgctgtttttgccttaagcagagagtaactctggaaggctgatgcttttctctgcttgctcgttctagtccagttgtatgctgtctgtggcacatgcttgatgttcaggccttaacttgaggagttgaagaatagatggaatctgaattctctgaagcaatttcttctagctcttctcttgtctttggaaaaccaatctttggctttgccagctcaccagtatcttcttcaggaagcacacatttccaaaggccatatgtttttcctaccacagtttgccagtctcagtgttccatcttcagaaccactggcatagagttctccatcaggatcaaatctcacacagtgaataggaccagagtgtcctttgtaggattctaattcttctccactattatcatcatacttataagtttaacatcttcaccacctgcaacaagaaattctttctcaaggtgaagagattcagagttaatgtttgcaggagcttgaaaggatttaattggttccaaacttactgtactgtcaaaagcactggatcagccataagttattaccaaaatctctccctcagaaatatattccatactactagccaacataataaaatttagagatttcacttctgtcatagtagcatgatcccaaagtcttaacagttttgtcatcagaagaaagaatctgtttatcctcactgtaccatagggcctttttaatatcagagctgtgatcactaatttcctcaggttctgcttcgggtttgttcaagtcatatatgcaaaacagtttattctgtcccctggttaacaaataattactatcctgcatgaaatccatagtcttgataatgtgtttatgagccagggtcatcagttcatctcctgggatagcatcccacactttgtgaaatctgcagctgctgtggctgctttggtggcatccttattcagtgttgcattccagacagcatctttatgacccaaaattgttccaatccagtctcctgtatctccctggcatagcataggtttgccgtctttgcaagcactgatttagaaatactcataagactggccaggcgcagtggctcacgcctgtaatcccagcactttgggaggccaaggcaggcggatcacctgaggtcagaagttcgagaccagctgggccaacatggtgaaaccccgtctctactaaaaatacaaaaattagccaggagtgatagcgcgcgcctgtaatcccagctactcgggaggctgaggcaggagaatcacttgaacctgggaggcggagtttgcagtgagccaagattgcaccactgcactccagcctgggcgacagagcaagattctgtcttgagggaaaaaaaagcccctaaggcatgatgccactgaaggccaagtcagccacgggccatatgtggccagaacaggtgagcagcatcagtctcattgctatggaggtggtgaacccagtgattgggctggtgggctgagggtcatccttgtcttttctcctctggtacagcgcccggggttcctccaggcttcaccctaacacgggctgagcagagaaaaaggaaaaggtggcaccgagattaggaaggagctagggaggggctggggagtctgggaagggtgagcaacagttgacaatggagggaggaaagtaggggatggggagaaccgaagaaacgacccagccactcttcgcaccgtccacactggtatcggcaggaagtgacatgttatgttttaacttataagaaaaagattttagcaaagttctgatttttctgtgttttaaaaattataataatgccaccacatcctgattgttaaaatatttatacttaagaagtttcctggctgggtgtgttggctcgtgcctgtaatcccagcactttggtaggtcaaggcaggcggatcacgaggtcaggagatcgagaccatcctggctgacacagtgaaacccatctctactaaaaatacaaagaaattagctgggcgtagtgggcgcctgtagtcccagctacttgggaggctgaggcaggagaatggcatgagcccgggaggtggagcttgcagtaagccaagataactgtgtctc

SEQ ID NO: 24053 - DNA, 970 bp, Homo sapiens
agcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataacta

SEQ ID NO: 24054 - DNA, 908 bp, Homo sapiens
gctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaa

SEQ ID NO: 24055 - DNA, 1254 bp, Homo sapiens
aacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaataaattctctgtagcagtaattgttaaatatacaaaaactgacagggcgattactttttgca

SEQ ID NO: 24056 - DNA, 1019 bp, Homo sapiens
gcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaagggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaataaa

SEQ ID NO: 24057 - DNA, 1094 bp, Homo sapiens
ggttctgcgcatgcgcgggggccatattagcagcggttattcggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaa

SEQ ID NO: 24058 - DNA, 786 bp, Homo sapiens
agtgccaagcctggacgccggggcccgcgagggggcgggctgagggtgggggtctgtgggcaggaccgagagttggggtggcttccgtcctcaggagttcggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatgg

SEQ ID NO: 24059 - DNA, 756 bp, Homo sapiens
ttagctctcccggaggtgccggtgaactcaaaatagtgctgtgcccggcgtcaggcgtggagacaacagaaagttgtgcttaaagctcgaatcagaaatccccggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaa

SEQ ID NO: 24060 - DNA, 944 bp, Homo sapiens
cccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactgg

SEQ ID NO: 24061 - DNA, 815 bp, Homo sapiens
ccacattataatctatgactgcctctctcacctaactgccagtattagcttttcaggacaggaactggttttacacattttggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgat

SEQ ID NO: 24062 - DNA, 912 bp, Homo sapiens
ctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaatatt

SEQ ID NO: 24063 - DNA, 985 bp, Homo sapiens
cttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaatatttgttaatagactgttctcttctaatagtcttttttttttttttttttttaa

SEQ ID NO: 24064 - DNA, 1029 bp, Homo sapiens
gcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataa

SEQ ID NO: 24065 - DNA, 912 bp, Homo sapiens
agtgtcctaggctgggagaatgggatggagcctccacctcatgaagtagcttcctttggaggtggctatggcaggtcttcggagagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttgg

SEQ ID NO: 24066 - DNA, 879 bp, Homo sapiens
acttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttggtcttttctctttttaggtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacct

SEQ ID NO: 24067 - DNA, 790 bp, Homo sapiens
ctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagtctcactttgtcgcccaggctgctccgcctcctgggttcaagcaattctcgtgcctcaacctcccaggtagctgggactacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaat

SEQ ID NO: 24068 - DNA, 814 bp, Homo sapiens
ctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataa

SEQ ID NO: 24069 - DNA, 1002 bp, Homo sapiens
gtgtttaaagtagtgcttctaccaacatgtcccgtggttccagcgccggttttgaccgccacattaccattttttcacccgagggtcggctctaccaagtaggtgagtgaaccaggttcgcctgtgggccacctgaattgccctgtcatgaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcctgttgttttca

SEQ ID NO: 24070 - DNA, 763 bp, Homo sapiens
caacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaagattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcct

SEQ ID NO: 24071 - DNA, 925 bp, Homo sapiens
cagcgcaggacacggcgccgagggtggggcgcgggcgtagtggcgccgggagtcgcgggtgcgcgcgggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcaggtgggtgcctgcccgcttgcatgctcacctctggcagcagggcagtcacggctccgccatggagggtcctgccatgtcacttcaggtgaatcagaaaactgatttattctggggcgtgatcctaatcttgacttgcacaagtgtaacttgacctagctcaccaatttcagtaacattgttctgttctcagttcctggcatgggatattccaaattcctgtgtctggagggaaatgatagcttttgtcttgccatcctgagtgaccagtcacaaagcagttgaagggggctggaagccaccctatgaggacacgccattagtatgtaagcagaatgtgtgtctacctgtcaaagtaatttccagtaacctgagttcacaattctggtcctaggtgagtttttctaggagtgaaaatgcagaaaaggatgttgaaagctattggctaatgta

SEQ ID NO: 24072 - DNA, 773 bp, Homo sapiens
ccgcccgggtcaggactggtttggacgcggccgtttcgttttgacgagggctcgtgtacattgaccttagtgacattgtttgaaacttaaattcgtaccatcaagacgtgtcagtttaattggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggtcggggtgccaagtcagtgcgcgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatga

SEQ ID NO: 24073 - DNA, 996 bp, Homo sapiens
cagcgcaggacacggcgccgagggtggggcgcgggcgtagtggcgccgggagtcgcgggtgcgcgcgggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggtcggggtgccaagtcagtgcgcgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtattttt

SEQ ID NO: 24074 - DNA, 685 bp, Homo sapiens
gcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggtcggggtgccaagtcagtgcgcgagttcctggagaagaactatactgacgaagccattgaaacagatgatctgaccattaagctggtgatcaaggcactcctggaaggaaaggtggttaatgctcctgtcttctgtcccttcaaggtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtattttt

SEQ ID NO: 24075 - DNA, 928 bp, Homo sapiens
agcgaacttcaggagaagccggaagtggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtactc

SEQ ID NO: 24076 - DNA, 660 bp, Homo sapiens
gagaagccggaagtggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccagtacatatcaagcaattcagtcagtttatgtgta

SEQ ID NO: 24077 - DNA, 1218 bp, Homo sapiens
aagagcaaggggctcagatggagggggaggaggacctgaacaagtccagaagggaagagatttgtccctctatccaacagagtacccagtgagcagcacagagggcacagcaagggacatcacccggttccccaaatgctcagagccacaagtgaagccaaaagtgaaagacaagatgcagaaaaccgccacgggcctttgaggaagggtaaaggcgaaagcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttaaacaga

SEQ ID NO: 24078 - DNA, 1894 bp, Homo sapiens
accagaccccagccacaaattcctggcttgcttcttccaaacttcattcagccccagggatggctctgcaggatgtgtgcaagtggcagtcccctgacacccagggaccatcacctcacctgcctcgggctggcggctgggctgtgccccggggttgtgaccctcaaaccttcctgcagatccatggccccagactggcccacggcaccaccactctggccttccgcttccgtcatggagtcattgctgcagctgacacgcgttcctcctgtggcagctatgtggcgtgtccagcctcatgcaaggtcatccctgtgcaccagcacctcctgggtaccacctctggcacctctgccgactgtgctacctggtatcgggtattacagcgggagctgcggcttcgggaactgagggagggtcagctgcccagtgtggccagtgctgccaagctcttgtcagccatgatgtctcaataccggggactggatctctgtgtggccactgccctctgcggctgggaccgctctggccctgagctcttctacgtctatagcgacggcacccgcctgcagggggacatcttctctgtgggctctggatctccctatgcctacggcgtgctagaccgtggctatcgctacgacatgagcacccaggaagcctacgccctggctcgctgcgccgtggcccacgccacccaccgtgatgcctattcagggggctctgtagaccttttccacgtgcgggagagtggatgggagcatgtgtcacgcagtgatgcctgtgtgctgtacgtggagttacagaagctcctggagccggagccagaggaggatgccagccatgcccatcctgagcctgccactgcccacagagctgcagaagatagagagctctctgtggggccaggggaggtgacaccaggagactccaggatgccagcagggactgagacggtgtgagaagcaggacttggttggggatggtgtaggcctggggagtgggtgggaggatgggcagcagggggagggtcccgctggcagcagcctcacagcgtctggctctagcctgtatgggttgctggcttcatttattgcaagtctccatcctttcatgactcccagagctattatggctctgcccaacaagttcctattgactcccagtggattggtccagcctccttcttggcaccaagtccgtctttcattcaacacttgcagtgtgcctactgcatgccagacgcatgctaggtgctagaccctcttttcttgccatcttctctgcttttttccatcatctcatccccagtttctcttagtttcggtcctttatgtgtctcagcttcagcgtctttgtctttttctcctgatcactttgtcagcatggtaagatggggcacccgggaagggagcagcccctctcagaacgaggcgtagtgatagacaccctttggatggtgatgggcttgtcttatctgctctccttctctgacttgaccatcatgactagaatgattatccctttactgaatgcagttctcatcgcaaccctttgaggtaaaaatgagtctctctttacagaagaggaatcaggttcaaagggttatgtggcttgccagggtcacacagtaagtggcagggatgacacttagatccaggccttctcctccagggtccatgctctttcagcacagctccccctcccaggccctctgccctgcctttcctctcttccctgcaggcttccggagagggatgtggagggagaaagtagctaggccagtcccctgcctggtggctcatgtggctttatcttccaggcctggagccatcccccacagcccacccttgctctccagctttctgggcctggcggtgccgctgccagactt

SEQ ID NO: 24079 - DNA, 2701 bp, Homo sapiens
ggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtaaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctaggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggttaacatta

SEQ ID NO: 24080 - DNA, 758 bp, Homo sapiens
agcggttgcgcagtgaaggctagacccggtttactggaattgctctggcgatcgagggatcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttcactcct

SEQ ID NO: 24081 - DNA, 964 bp, Homo sapiens
acttccgcttccgttggcgcaagcgctttcattttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgcttgctga

SEQ ID NO: 24082 - DNA, 1294 bp, Homo sapiens
aggactacttgcatgaccaaagccaagatggcaggtacgtccttttagaatttaaggttagtgaagccatctatttccccgacccccttcagtgaaaatggtctttcgcatctggcccttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaatctca

SEQ ID NO: 24083 - DNA, 900 bp, Homo sapiens
cttctcaaagatggccgacctcacttcccttacgcaacatggacgttttcagtcacttcctgtgattttgaggttattctgatccaggactacttgcatgaccaaagccaagatggcagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactat

SEQ ID NO: 24084 - DNA, 1117 bp, Homo sapiens
acactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctgtgtctgaagttctgtgcttgaaacctaagtcatttggaatgtacttgttttgtgggtgtgctgagaggatcggcaacatggcaaggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactc

SEQ ID NO: 24085 - DNA, 980 bp, Homo sapiens
gctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctg

SEQ ID NO: 24086 - DNA, 650 bp, Homo sapiens
gaactgctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatggtccattgtgaagaggagctctttacagagaatcttttctttattaggcaagctgaagtagtgtcagaagaagcttggggaccatcttttgctattagcttggcagtgttccttgtagcag

SEQ ID NO: 24087 - DNA, 988 bp, Homo sapiens
actgctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggtgagtgaaggagacgaagttcttcctgggtcccctggcgtcgtggccacccttggtatctccatggcatctggatggagttttcctggttctttccacattaagtacatccagtgttcccaaatcaacctcccacacagaccttcggcttgttacttgctttatgacagtgggctgctgtcaggtgtaggaaagtgatttaatttgatgggagaggtggagggtggcccaggaaagagccctaggctgggaggtggggccggagaggtttggatcatctgctgtcctttctcaagtgtcttaaagaatcccctgatttctgggagaaggtgcatttttcagggcagccccagcactttccctca

SEQ ID NO: 24088 - DNA, 1351 bp, Homo sapiens
gaagaggcggggtttagaggcgtgaaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 24089 - DNA, 1124 bp, Homo sapiens
gctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 24090 - DNA, 1124 bp, Homo sapiens; identical to SEQ ID NO: 24089

SEQ ID NO: 24091 - DNA, 1351 bp, Homo sapiens; identical to SEQ ID NO: 24088

SEQ ID NO: 24092 - DNA, 1025 bp, Homo sapiens
cagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattaactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 24093 - DNA, 1025 bp, Homo sapiens; identical to SEQ ID NO: 24092

SEQ ID NO: 24094 - DNA, 1351 bp, Homo sapiens; identical to SEQ ID NO: 24088

SEQ ID NO: 24095 - DNA, 1351 bp, Homo sapiens; identical to SEQ ID NO: 24088

SEQ ID NO: 24096 - DNA, 1124 bp, Homo sapiens; identical to SEQ ID NO: 24089

SEQ ID NO: 24097 - DNA, 1025 bp, Homo sapiens; identical to SEQ ID NO: 24092

SEQ ID NO: 24098 - DNA, 1025 bp, Homo sapiens; identical to SEQ ID NO: 24092

SEQ ID NO: 24099 - DNA, 1124 bp, Homo sapiens; identical to SEQ ID NO: 24089

SEQ ID NO: 24100 - DNA, 1299 bp, Homo sapiens
agcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 24101 - DNA, 1351 bp, Homo sapiens; identical to SEQ ID NO: 24088

SEQ ID NO: 24102 - DNA, 1124 bp, Homo sapiens; identical to SEQ ID NO: 24089

SEQ ID NO: 24103 - DNA, 1351 bp, Homo sapiens; identical to SEQ ID NO: 24088

SEQ ID NO: 24104 - DNA, 1124 bp, Homo sapiens
gctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgaagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 24105 - DNA, 1025 bp, Homo sapiens; identical to SEQ ID NO: 24092

SEQ ID NO: 24106 - DNA, 1025 bp, Homo sapiens; identical to SEQ ID NO: 24092

SEQ ID NO: 24107 - DNA, 1025 bp, Homo sapiens
cagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgaagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattaactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 24108 - DNA, 1351 bp, Homo sapiens; identical to SEQ ID NO: 24088

SEQ ID NO: 24109 - DNA, 1124 bp, Homo sapiens; identical to SEQ ID NO: 24089

SEQ ID NO: 24110 - DNA, 1125 bp, Homo sapiens
gctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaatac

SEQ ID NO: 24111 - DNA, 1025 bp, Homo sapiens; identical to SEQ ID NO: 24092

SEQ ID NO: 24112 - DNA, 1090 bp, Homo sapiens
ttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagt

SEQ ID NO: 24113 - DNA, 782 bp, Homo sapiens
gcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaa

SEQ ID NO: 24114 - DNA, 782 bp, Homo sapiens; identical to SEQ ID NO: 24113

SEQ ID NO: 24115 - DNA, 782 bp, Homo sapiens; identical to SEQ ID NO: 24113

SEQ ID NO: 24116 - DNA, 792 bp, Homo sapiens
ggaccatcacactggggaccggcttctctgctctcccgttatgggggtcgggggaatgatgggtcaagggtcttccgaagaaagcgagaaaggaacaggcgccttcaaaagcccacttggcgatgggttacagtaagagaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaa

SEQ ID NO: 24117 - DNA, 640 bp, Homo sapiens
ggatgctgcgggcgggagcaccaaccggggacttaccccgggcgggagaagtccacaccgggaccaccatcatggcagtggagtttgacgggggcgttgtgatgggttctgattcccgagtgtctgcagggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctacttctactaaaagaagagtatgtggatactttctaagaactcaaaaacgagaaaaccaaaatcagagggtgcatgaatatatgtgcacaggtgagaggtcactatcctcctctccactgctttcttgttcctgaacctgatactttggctccaagccttcagcagcagctaagttcttagccaagctatctgttgccatagcttcagtggtttctgtatcactacatgcatcttc

SEQ ID NO: 24118 - DNA, 792 bp, Homo sapiens; identical to SEQ ID NO: 24116

SEQ ID NO: 24119 - DNA, 640 bp, Homo sapiens; identical to SEQ ID NO: 24117

SEQ ID NO: 24120 - DNA, 792 bp, Homo sapiens; identical to SEQ ID NO: 24116

SEQ ID NO: 24121 - DNA, 640 bp, Homo sapiens; identical to SEQ ID NO: 24117

SEQ ID NO: 24122 - DNA, 439 bp, Homo sapiens
gccaggcgagccaggaaggaccagcgggcgaggtgaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatcta

SEQ ID NO: 24123 - DNA, 439 bp, Homo sapiens; identical to SEQ ID NO: 24122

SEQ ID NO: 24124 - DNA, 439 bp, Homo sapiens; identical to SEQ ID NO: 24122

SEQ ID NO: 24125 - DNA, 439 bp, Homo sapiens; identical to SEQ ID NO: 24122

SEQ ID NO: 24126 - DNA, 661 bp, Homo sapiens
cgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcagggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctacttctactaaaagaagagtatgtggatactttctaagaactcaaaaacgagaaaaccaaaatcagagggtgcatgaatatatgtgcacaagtgagaggtcactatcctcctctccactgctttcttgttcctgaacctgatactttggctccaagccttcagcagcagctaagttcttagcaagctatctgttgccatagcttcagtggtttctgtatcactacatgcatcttc

SEQ ID NO: 24127 - DNA, 439 bp, Homo sapiens
gccaggcgagccaggaaggaccagcgggcgaggtgaccaccatcatggcagtggagtttgacgggggcgttgtgatgggttctgattcccgagtgtctgcaggcgaggcggtggtgaaccgagtgtttgacaagctgtccccgctgcacgagcacatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatcta

SEQ ID NO: 24128 - DNA, 792 bp, Homo sapiens; identical to SEQ ID NO: 24116

SEQ ID NO: 24129 - DNA, 782 bp, Homo sapiens; identical to SEQ ID NO: 24113

SEQ ID NO: 24130 - DNA, 792 bp, Homo sapiens
ggaccatcacactggggaccggcttctctgctctcccgttatgggggtcgggggaatgatgggtcaagggtcttccgaagaaagcgagaaaggaacaggcgccttcaaaagcccacttggcgatgggttacagtaagagaccaccatcatggcagtggagtttgacgggggcgttgtgatgggttctgattcccgagtgtctgcaggcgaggcggtggtgaaccgagtgtttgacaagctgtccccgctgcacgagcacatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaa

SEQ ID NO: 24131 - DNA, 661 bp, Homo sapiens; identical to SEQ ID NO: 24126

SEQ ID NO: 24132 - DNA, 673 bp, Homo sapiens
cgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcagggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctacttctactaaaagaagagtatgtggatactttctaagaactcaaaaacgagaaaaccaaaatcagagggtgcatgaatatatgtgcacaagtgagaggtcactatcctcctctccactgctttcttgttcctgaacctgatactttggctccaagccttcagcagcagctaagttcttagcaagctatctgttgccatagcttcagtggtttctgtatcactacatgcatcttcatcatcacccat

SEQ ID NO: 24133 - DNA, 782 bp, Homo sapiens
gcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcacatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaa

SEQ ID NO: 24134 - DNA, 792 bp, Homo sapiens; identical to SEQ ID NO: 24130

SEQ ID NO: 24135 - DNA, 782 bp, Homo sapiens; identical to SEQ ID NO: 24133

SEQ ID NO: 24136 - DNA, 439 bp, Homo sapiens; identical to SEQ ID NO: 24122

SEQ ID NO: 24137 - DNA, 439 bp, Homo sapiens; identical to SEQ ID NO: 24127

SEQ ID NO: 24138 - DNA, 792 bp, Homo sapiens; identical to SEQ ID NO: 24130

SEQ ID NO: 24139 - DNA, 782 bp, Homo sapiens; identical to SEQ ID NO: 24113

SEQ ID NO: 24140 - DNA, 640 bp, Homo sapiens; identical to SEQ ID NO: 24117

SEQ ID NO: 24141 - DNA, 640 bp, Homo sapiens; identical to SEQ ID NO: 24117

SEQ ID NO: 24142 - DNA, 792 bp, Homo sapiens; identical to SEQ ID NO: 24116

SEQ ID NO: 24143 - DNA, 782 bp, Homo sapiens; identical to SEQ ID NO: 24133

SEQ ID NO: 24144 - DNA, 534 bp, Homo sapiens
gcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcagggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacggtaaccagccaagtggaagggtacctggggagggctttgaaacatgggaaggaagtagattatga

SEQ ID NO: 24145 - DNA, 439 bp, Homo sapiens; identical to SEQ ID NO: 24127

SEQ ID NO: 24146 - DNA, 534 bp, Homo sapiens; identical to SEQ ID NO: 24144

SEQ ID NO: 24147 - DNA, 1089 bp, Homo sapiens
gctgcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcagggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacggtaaccagccaagtggaagggtacctggggagggctttgaaacatgggaaggaagtagattatgaggaacaggaagagaaatacaggggtggccatttaagttaatgccgggcctggtacacttttaagagtgaaaaggggcaggacaaatgcaaagctcaatggggctcttgggcaatacggataaaccagggctgttctgagtaaatcaaatgaggatacacagtcactgtgagaaccagtggtgtgctaagcacagtggctcacacctgtaatgccaacaatttgggaggctgaggcaggaggattacttgagcccaggagtttgaggccagcctaggcaagatggtgaaaccctgtctccacaaaaaacaataaaaaaaagtaaaaaaaaaatgaactgggcatagtggtgcacacctgtagtcccagctactcaggaggctgaggtggaaagatcatctgagccggggagatcaaggctgtagtgagcggtgattgcaccactgcgctgcagcctaggtgacagagagagaccctgtctggagaaaaaaaaaaaaaaaaaagaaccagtggtgtgctgaggtgtgctgaggctggcttgggaccactcatga

SEQ ID NO: 24148 - DNA, 534 bp, Homo sapiens; identical to SEQ ID NO: 24144

SEQ ID NO: 24149 - DNA, 534 bp, Homo sapiens; identical to SEQ ID NO: 24144

SEQ ID NO: 24150 - DNA, 1089 bp, Homo sapiens; identical to SEQ ID NO: 24147

SEQ ID NO: 24151 - DNA, 534 bp, Homo sapiens; identical to SEQ ID NO: 24144

SEQ ID NO: 24152 - DNA, 1089 bp, Homo sapiens; identical to SEQ ID NO: 24147

SEQ ID NO: 24153 - DNA, 1330 bp, Homo sapiens
gccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaaaaaagttgttgctcatgaatattataaaatgatctacaggtttcaattcaacctgtttctaggtttttttgtaaatttagttttgattaagcattataagcatttgagtctataaactttatagtagcatctttcagaataaacatttttaattgatttcagtggcaactctcaaattgattacaatatgagatatatcagtgtcgtccattaacactcataagaataatatttactgtgtcagtgctattttaggattatagttattgtttgattatttcaggttgaaaagtagaagttccaaggttttgattttggtctggtctttaagtgaaaaattaaagcaaccagtagatgtaggttaaacttttacttcatagacttaatatgtaattaatatattgccaagcaacactgttaaagaaaagtaaaactcattttttcttgttcttaatttatatattacaagatactgtaaggtattctttatgaagttgatatataaaaatttacatttttagaacattagtgaatggatcatcttttacaattaaaagtatattttgattatcagtttcttaggaa

SEQ ID NO: 24154 - DNA, 1321 bp, Homo sapiens
tgagatgcggctttcaggcatttgtttaggacatgcccatggcggggcttctaaaggggcttgtacggcaactggagcggttcagcgttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaacacagcta

SEQ ID NO: 24155 - DNA, 1605 bp, Homo sapiens
aattgagatgcggctttcaggcatttgtttaggacatgcccatggcggggcttctaaaggggcttgtacggcaactggagcggttcagcgttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaaagtggattattttgcagatggctgatctcatctattcaatgttgattctattagttccaatttcagaaggtgacattttctgactttgtccccttaagcacaaacaaaaactatggatttttgtttttgttttcagaaaagagaaagtacaaggtgtgcttggggaacagcaaggaaaccagacagatgtgggggcgggtttgtaggggaactgctggatgtacctcattaatttgttcatttgttcagcacccacagggtgccagtgaacgggctaggtgctggggatagagtggtgaacaagatgagccttatgcacctcacagtctcctgggggagacagccaaatagacaattttaatacaatgtggcaaattctatgatgggaagaagagagaaatggtgtgtgtgagtccctcaccttcccagaggtttcccaggggaagcaacgtttcagctgagacctgaaggatggatgacagtccaccagaaaaaagttagtggagcggggacaagcagggttgcagagtggaagaaaaatgttcctgtgagaagaaactgtccaaagagtctgaagagaaaagggaacagggtgaatttgaggccctacaagaaaaacaggagaccattcaacaggagacgcccagggagcaggtggctttgtgggcctgatgtccaagaaagaagtcgtggtggtaaacagagacttgggattgcaagctactgttgtctttctattgaaaaaatagctgagcaccacactagggaggccttgcaaggacagcccaaagaatttgaacttgattctacaggcagtgattttgaacaagaggttttgaagagaacgtgacacacgtcaagctgagctctagggagtgggcagcagcctgcagaagagggactaggctaggagcacagaaagtagcccacggcagaggtagcagaaggaatggaggagtgcccatgtgaggggtactgaggtggcacacttgccagaatcagggcagcctgcttggtctcataccagctggaaccagttcctaccagctcccaagggctaattgttaaactttcaggaattttctcagcattcattaaaaatgaaaaaaagtatcaatattaaaaatatttttgctggacatggtgtctcaggcctgtaatcccagct

SEQ ID NO: 24156 - DNA, 1393 bp, Homo sapiens
attgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 24157 - DNA, 1618 bp, Homo sapiens
aagggggggtcttggcggccggaggaggagtaggtgcgggtgaagatggcggcagccgaggccgcgaactgcatcatggagaattttgtagccaccttggctaatgggatgagcctccagccgcctcttgaagaagtaacccccctttgcccttccctgtgtctgcccccattttccttcccctcccctccccagctgtgggctgagctagagacggggtcagagagactggagagatggtaggcgtggctgaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggtgagggggtgggcatggccaggtgccccctgggttgaaaccaaagagaggccatcacctggccctggcatgggactttggggcccagaatgttggcctgaggtctcagagcctgatctgccagccagaggtggtgctagaggcccaggaaagacacttcgtcctttaaatatctttgtgagcgctgctgtgtgagaaccatgcttggcacttggcttctggcggaggaaacacccaaagctggcagctaaagcccacagcccatgcacggaaaggcaggaccccagggcgatgagcggatgcacatgcacgcgggccactgcagaagagcacggggccaggctgggctccgagatgtgcctgaggtcccagctactcgggaggatcacttgggcctgggagttcaaggctgcagtgagctgtgatcacatcactgcactccagctttggtgacaatgttttgttttgttttttccttttgtttttttttacttctgagaccctgtttaaaaaaaaaaaatacggcgatgagtatttgttgagctgggatgtgtgagccgggtgaagctgggtggctgaccgggggatcctgtcggggaggagaggtggacatctataccgtcaaggtggaagacctgaccttcacctccccgttctgcctgcaagtgaagcggaatgactacgtgcacgccctg

SEQ ID NO: 24158 - DNA, 1327 bp, Homo sapiens
cgggtgaagatggcggcagccgaggccgcgaactgcatcatggagaattttgtagccaccttggctaatgggatgagcctccagccgcctcttgaagaagtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 24159 - DNA, 578 bp, Homo sapiens
gagctttaccctactggagccgtttatctcccccgggtctttgtgagggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggca

SEQ ID NO: 24160 - DNA, 699 bp, Homo sapiens
caaagagcgagctcattccgggattggagagaagtgtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctca

SEQ ID NO: 24161 - DNA, 1182 bp, Homo sapiens
agtgcagtggcgcgatctcagctcactgcaagctccgcctcccgggttcacgccatcctcctgcctaagcctccacgcccggctaattttttgtatttttagtagagacgggggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgtgagcagagggaagtagagggatcggggagaggaggggcaggacccacgcattcggccctttgcattcagcttcattcaactaggaactttttctgcaaatcaaggaaagcttcccggaggaagtggtgcctaagctgtgctctgattcacgtttagaagctgaccagacaaagagaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccgg

SEQ ID NO: 24162 - DNA, 785 bp, Homo sapiens
agagttggcaaacccctgacctatgatggacgtattctctagccaattactagacggtattctcagacgggccgcctccattgccaatgaaatcttccagcggggtcgcggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggtgagg

SEQ ID NO: 24163 - DNA, 1480 bp, Homo sapiens
ggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctggttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtga

SEQ ID NO: 24164 - DNA, 1334 bp, Homo sapiens
tgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctggctgcgcctctcctgagctgccgcattctcccctgcacctgtgcgtctggccctcttcacgtcctcctggcctgctgtctgcctctcccctgcacctgtgcgtctgtccctcttcatgtcctccttgcctgctgtctgcctgttctcagagcccctcagccctcaggccttcatctctcctggcccatcttcctactctgacgctgacatgtagtaaaagtctgaagacagagaagagtgcatgtgcgtttagcataggaggggcagctttcagtcagtgcagcaagggcatgtagttgttcagagatggtgctggaacgactgatttggagaaaagaggcccttcttcacaccatctgctaaaataaacctcagatgggctcaagagttaaatatttaagaaaaggaggaaacaaaaaaattgctacaagtttatttgttgttaggatgggaaaggtttttctaagaaccaagttcataatgaagctgtcaaataaaatacttgacaaaaaa

SEQ ID NO: 24165 - DNA, 2688 bp, Homo sapiens
acttatccagaagaaaggcagagggcgcacactgcgcagcgcggatgggaaagttaactgaattatttgcgggaagacagaggaggtggggggtcccccaagccccagccattttgtggctcgtaggggttgtcgcttcccaagccgtgaatggcccaaacccgccccccgccccaggtcggactcctgccccgcgcccctctgggtcggaccccaagccgagccccccaaccccgcggctgggctgggcgattggggacgagctccacacatggagaacctggcctcgcctcgcaagaccgcgggacgcgcagatgtgaagtgcgcctgcgcggggcgcagccccagctgcagacgatctgtgagcgacgcgccggcgcaagtcgagggcggtggcttggcttccctggaatgggggacgtcttaggactgcgcctgcgcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagagcagtgtgtggattacactatcactggaaaaatacgaattgagaagaaggaaaagactggaagatgcagaccttggttcctgttagtggaaacactgtaaggtcccagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtca

SEQ ID NO: 24166 - DNA, 1301 bp, Homo sapiens
gggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgcggataaagtcatcctggacgtgggctgtgggactgggatcatcagtctcttctgtgcacactatgcgcggcctagagcgggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggagacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattag

SEQ ID NO: 24167 - DNA, 2880 bp, Homo sapiens
gcgtgcactgcgcttgcgcgggttgagggcggtggctcaggctcctggaaaggaccgtccacccctccgcgctggcggtgtggacgcggaactcagcggagaaacgcgattgaggtaggtgtcctgatgggcagctcagatggctggactgcacgtaaggaaggacaggccaggtgaggcgtcctcgcactgcgtgtgcgtcgctggcggacagaggcctccgcccccttttgggacctccgagcgccttcgcgatctcagccactttccctggcgtccaaacgggagctcggtccccgtcacacccttccctgcgtgccgcaccccttcccggccactcccgccgtccagcgccttctacggccacgcccaccccaccaccatctctgtcacgcccttcgcggccacgcccacctgcctggcggcccctgccccgaagctcgcggcgctgtcccagcctgaccctctcgtgcccctgcgtccacgcgtggccctctcgcttcctgcccccttctcaccccccttcactggccacctgttccaaccctccatgatcctgttcctcccgagggcatcttaggagggcagggtcctgcgcgcactgcggcctccactccgaccccgtcccagtttggacccaggtcttccaatgaaaatataattatgcaaatcagtaagcatttgtaactacgaatatcacaaaaataagcttcaagtctggatttagaagtgaagcatgcattttaaacaaagaattgctatgcaattttaaaaacacattgatcccagagcagtgtgtggattacactatcactggaaaaatacgaattgagaagaaggaaaagactggaagatgcagaccttggttcctgttagtggaaacactgtaaggtcccagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtca

SEQ ID NO: 24168 - DNA, 2131 bp, Homo sapiens
cgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtca

SEQ ID NO: 24169 - DNA, 1932 bp, Homo sapiens
gtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtcattgtgtatcctgttttatgcatatatgttattttttgtaattacaggatcatactatatgcattgctttataagtttttctcaatattgtgaaaaaacttccacatcagtagatacatgtccataatttttttttgtattgttttgatttttattaaattttattgaaatata

SEQ ID NO: 24170 - DNA, 1656 bp, Homo sapiens
ggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtga

SEQ ID NO: 24171 - DNA, 1652 bp, Homo sapiens
ggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgcaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtga

SEQ ID NO: 24172 - DNA, 2639 bp, Homo sapiens
agaagcccccgtttcctggagcccgcgccgtgccgcgctacgcccgccgggagccgggcagagcggccaagatgtcgcagcccaagaaaagaaagcttgagtcggggggcggcggcgaaggaggggagggaactgaagaggaagatggcgcggagcgggaggcggccctggagcgaccccggaggactaagcgggaacgggaccagctgtactacgagtgctactcggacgtttcggtccacgaggagatgatcgcggaccgcgtccgcaccgatgcctaccgcctgggtatccttcggaactgggcagcactgcgaggcaagacggtactggacgtgggcgcgggcaccggcattctgagcatcttctgtgcccaggccggggcccggcgcgtgtacgcggtagaggccagcgccatctggcaacaggcccgggaggtggtgcggttcaacgggctggaggaccgggtgcacgtcctgccgggaccagtggagactgtagagttgccggaacaggtggatgccatcgtgagcgagtggatgggctacggactcctgcacgagtccatgctgagctccgtcctccacgcgcgaaccaagtggctgaaggagggcggtcttctcctgccggcctccgccgagctcttcatagcccccatcagcgaccagatgctggaatggcgcctgggcttctggagccaggtgaagcagcactatggtgtggacatgagctgcctggagggcttcgccacgcgctgtctcatgggccactcggagatcgttgtgcagggattgtccggcgaggacgtgctggcccggccgcagcgctttgctcagctagagctctcccgcgccggcttggagcaggagctggaggccggagtgggcgggcgcttccgctgcagctgctatggctcggcgcccatgcatggctttgccatctggttccaggtgaccttccctggaggggagtcggagaaacccctggtgctgtccacctcgccttttcacccggccactcactggaaacaggcgctcctctacctgaacgagccggtgcaagtggagcaagacacggacgtttcaggagagatcacgctgctgccctcccgggacaacccccgtcgcctgcgcgtgctgctgcgctacaaagtgggagaccaggaggagaagaccaaagactttgccatggaggactgagcgttgccttttctcccagctacctcccaaagcagcctgacctgcgtgggagaggcgtagcgaggtcggaggggaaagggagatcccacgtgcaagtagggggaatatctcccccttttccctcatagcctctagggagggagagtgacttcattctccatttgaagagattcttctggtgatgtttacttaaaaagtgatccccctcaacaacggatacagcgtgcttattattgggcatttagcctcaaaagcatgtagtaccaagcacttgtatttccgtatattttgtttcgcgggggagtgagggggaagaacacggatgaaaatgtcagtttttgaagggtccatgcacatccctgacacctcacaccttatctaagtctgaagctggggagaaaggggttcatttagacttcatacatttccagtacgactttagtatctctccagagccatattttctcagtccgaattaattccccctccctaggtgcctgtaggctatggtacttcttcctcattgttttctaggtaaacttcactactggtaattaaggggaaggatatgaggaagcagtttaaatagccctgttctcattactctgaccacatacatcatagggtgctaaagttgatgaacacattaatccgttaagtaaaatggactttgtaattgtacagcatacctaagaaactcagaaggtgcatttaagagagagacctgaaagaaatagtatggatttttaaaaattcttgtctctactattataaccaaaaaatatttcttgtatgtcccataaaaatatttgtgtaattcttatgaaacaggctggtagaggaggtttctgagcctagcccaagggcttattcatcaccatgggtaaattatttaaactcacttaattaaggaaaatattttcccagctagaaaagtatactcattctcatttaaactctctcatttggagggatcatgtgagttggcctacttacaagtagtgaaagttcccttttcagttttgttttgttttgttttgtttttctctttcactcagccaaatgtgaaagttgtgaatttaggaaaatcacttgtaatgaagtgtgaatcttgttatcaaatttatttctctgatgtttccttccttatccttgtagccaataaaacattgacattctcacgttttatagatgaggtaaaaagtcttgtgtgctgtgagttataatgcttttgcctttttaatattattagttcttaagtgttacagccccttcagaatataacttcaggacaattcaaactatgcttaatgtatgattttcgagcttctgtatgctaagaaaataggtgtgaaaaactggtgttctgaaatagcctaacatttattgtaattctgaattttctgcccttttattcattgcatattaaagtattagagt

SEQ ID NO: 24173 - DNA, 2616 bp, Homo sapiens
gcgctacgcccgccgggagccgggcagagcggccaagatgtcgcagcccaagaaaagaaagcttgagtcggggggcggcggcgaaggaggggagggaactgaagaggaagatggcgcggagcgggaggcggccctggagcgaccccggaggactaagcgggaacgggaccagctgtactacgagtgctactcggacgtttcggtccacgaggagatgatcgcggaccgcgtccgcaccgatgcctaccgcctgggtatccttcggaactgggcagcactgcgaggcaagacggtactggacgtgggcgcgggcaccggcattctgagcatcttctgtgcccaggccggggcccggcgcgtgtacgcggtagaggccagcgccatctggcaacaggcccgggaggtggtgcggttcaacgggctggaggaccgggtgcacgtcctgccgggaccagtggagactgtagagttgccggaacaggtggatgccatcgtgagcgagtggatgggctacggactcctgcacgagtccatgctgagctccgtcctccacgcgcgaaccaagtggctgaaggagggcggtcttctcctgccggcctccgccgagctcttcatagcccccatcagcgaccagatgctggaatggcgcctgggcttctggagccaggtgaagcagcactatggtgtggacatgagctgcctggagggcttcgccacgcgctgtctcatgggccactcggagatcgttgtgcagggattgtccggcgaggacgtgctggcccggccgcagcgctttgctcagctagagctctcccgcgccggcttggagcaggagctggaggccggagtgggcgggcgcttccgctgcagctgctatggctcggcgcccatgcatggctttgccatctggttccaggtgaccttccctggaggggagtcggagaaacccctggtgctgtccacctcgccttttcacccggccactcactggaaacaggcgctcctctacctgaacgagccggtgcaagtggagcaagacacggacgtttcaggagagatcacgctgctgccctcccgggacaacccccgtcgcctgcgcgtgctgctgcgctacaaagtgggagaccaggaggagaagaccaaagactttgccatggaggactgagcgttgccttttctcccagctacctcccaaagcagcctgacctgcgtgggagaggcgtagcgaggtcggaggggaaagggagatcccacgtgcaagtagggggaatatctcccccttttccctcatagcctctagggagggagagtgacttcattctccatttgaagagattcttctggtgatgtttacttaaaaagtgatccccctcaacaacggatacagcgtgcttattattgggcatttagcctcaaaagcatgtagtaccaagcacttgtatttccgtatattttgtttcgcgggggagtgagggggaagaacacggatgaaaatgtcagtttttgaagggtccatgcacatccctgacacctcacaccttatctaagtctgaagctggggagaaaggggttcatttagacttcatacatttccagtacgactttagtatctctccagagccatattttctcagtccgaattaattccccctccctaggtgcctgtaggctatggtacttcttcctcattgttttctaggtaaacttcactactggtaattaaggggaaggatatgaggaagcagtttaaatagccctgttctcattactctgaccacatacatcatagggtgctaaagttgatgaacacattaatccgttaagtaaaatggactttgtaattgtacagcatacctaagaaactcagaaggtgcatttaagagagagacctgaaagaaatagtatggatttttaaaaattcttgtctctactattataaccaaaaaatatttcttgtatgtcccataaaaatatttgtgtaattcttatgaaacaggctggtagaggaggtttctgagcctagcccaagggcttattcatcaccatgggtaaattatttaaactcacttaattaaggaaaatattttcccagctagaaaagtatactcattctcatttaaactctctcatttggagggatcatgtgagttggcctacttacaagtagtgaaagttcccttttcagttttgttttgttttgttttgtttttctctttcactcagccaaatgtgaaagttgtgaatttaggaaaatcacttgtaatgaagtgtgaatcttgttatcaaatttatttctctgatgtttccttccttatccttgtagccaataaaacattgacattctcacgttttatagatgaggtaaaaagtcttgtgtgctgtgagttataatgcttttgcctttttaatattattagttcttaagtgttacagccccttcagaatataacttcaggacaattcaaactatgcttaatgtatgattttcgagcttctgtatgctaagaaaataggtgtgaaaaactggtgttctgaaatagcctaacatttattgtaattctgaattttctgcccttttattcattgcatattaaagtattagagtataaaaactaa

SEQ ID NO: 24174 - DNA, 1718 bp, Homo sapiens
agagcggccaagatgtcgcagcccaagaaaagaaagcttgagtcggggggcggcggcgaaggaggggagggaactgaagaggaagatggcgcggagcgggaggcggccctggagcgaccccggaggactaagcggtgcggttcaacgggctggaggaccgggtgcacgtcctgccgggaccagtggagactgtagagttgccggaacaggtggatgccatcgtgagcgagtggatgggctacggactcctgcacgagtccatgctgagctccgtcctccacgcgcgaaccaagtggctgaaggagggcggtcttctcctgccggcctccgccgagctcttcatagcccccatcagcgaccagatgctggaatggcgcctgggcttctggagccaggtgaagcagcactatggtgtggacatgagctgcctggagggcttcgccacgcgctgtctcatgggccactcggagatcgttgtgcagggattgtccggcgaggacgtgctggcccggccgcagcgctttgctcagctagagctctcccgcgccggcttggagcaggagctggaggccggagtgggcgggcgcttccgctgcagctgctatggctcggcgcccatgcatggctttgccatctggttccaggtgaccttccctggaggggagtcggagaaacccctggtgctgtccacctcgccttttcacccggccactcactggaaacaggcgctcctctacctgaacgagccggtgcaagtggagcaagacacggacgtttcaggagagatcacgctgctgccctcccgggacaacccccgtcgcctgcgcgtgctgctgcgctacaaagtgggagaccaggaggagaagaccaaagactttgccatggaggactgagcgttgccttttctcccagctacctcccaaagcagcctgacctgcgtgggagaggcgtagcgaggtcggaggggaaagggagatcccacgtgcaagtagggggaatatctcccccttttccctcatagcctctagggagggagagtgacttcattctccatttgaagagattcttctggtgatgtttacttaaaaagtgatccccctcaacaacggatacagcgtgcttattattgggcatttagcctcaaaagcatgtagtaccaagcacttgtatttccgtatattttgtttcgcgggggagtgagggggaagaacacggatgaaaatgtcagtttttgaagggtccatgcacatccctgacacctcacaccttatctaagtctgaagctggggagaaaggggttcatttagacttcatacatttccagtacgactttagtatctctccagagccatattttctcagtccgaattaattccccctccctaggtgcctgtaggctatggtacttcttcctcattgttttctaggtaaacttcactactggtaattaaggggaaggatatgaggaagcagtttaaatagccctgttctcattactctgaccacatacatcatagggtgctaaagttgatgaacacattaatccgttaagtaaaatggactttgtaattgtacagcatacctaagaaactcagaaggtgcatttaagagagagacctgaaagaaatagtatggatttttaaaaattcttgtctctactattataaccaaaaaatatttcttgtatgtcccataaaaatatttgtgtaattcttatg

SEQ ID NO: 24175 - DNA, 1449 bp, Homo sapiens
gacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccctcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggc

SEQ ID NO: 24176 - DNA, 1538 bp, Homo sapiens
agacagaatcttgccgcatgacccaggctagaatgcagtggtgtgatctcggccctctgcaacctccacctcccagagacgttcgccatattggccaggctggtctcaaactcctggcctcaagtgatctgcccacctcggcctcccaaagtgccagcagcatgctcggaggagtgactttaaagcttttctacttgcttcctagaactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccctcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggca

SEQ ID NO: 24177 - DNA, 11716 bp, Homo sapiens
aaaaccagtagcatcagcagcagcagcagcagccgccgccgccaccaccgccgccacagcagtagcattagcggcagtagcagcatttagcaatagctttaacagctatagcgacagtagcagccgccctcctctctccctctcgcggacggccgcagccaccgcacagagcgggctccaggcgccgagcgcgcagcccgctcgctaggtagctccagccggggcgagcgacagtgtaagcgaagcacggacccttggagcagccgggcagccgcggaggctctgagtttcagggccagagcccgacagctctgactccatctagcgcggcggcggcggagcctgagggagcgagcgaggagagaggcgcgtccacctggcgggcccagcgtatggagctgaggcagaggcggcggcggcggcggcagcagtagcagcggcggtggcggctaaggcagctcgaacagctgcggcgacggcgacagcccagccttgactgcgaccgcgctagctacagcgcctgctgcctgagcccgccagcgacgtgcgcctcgggagtcggcctgtgaggttggacagcatttggacttggaatgaaacaataagaggttatattcatggataaccaacaagataaggctattgttgcctcagccaacggagaaaacactctgattaatggggtcaaagaaaatgactcagaggaccaggatgtggcaatgaagtcatttgcagctctagaagctgctgcacctatccagcctacaccggtggcacaaaaagagaccctgatgtatcccagaggtctcctgcctctaccctctaagaagccctgtatgcagagcccgccctctcctttgggcctgattgaagcacccgaacatgctgctaatagtgcttctgtgaatgccatctccctcacatctggcattgcaaaaggcctgaacacatggtcacttcccaatgaatgtgagaaagctccatttgccataatggagcctgcaggcatgtcagctctgaatggggactgtctcatgcagccaagtcggacttgcttaggctgcttcatggaatccaaggatgcagtagatcctgagccagggatcagtctgaaagttggtgatctaaatagggattatgaaacgtgtgcagtctctgatatagggattcagtgtattaatgctggagaaaatatgaaatatggagagcagctgctctcagaccagctcctaggcttccccctgcataagtcaagggcaggagacagacgagaaactgagaaacctgacattgacttggaggatccggctcagaaaagctattatgaggcattactgttagacaagtgcaatacagaagaagctttgcttgcaaattccaatcaggattggggttacttcgagacttttattagtgaaagtaagattgaactgcttgacctctgttccaaaaatgagctgtctgtcaacctattctctgaagaagatgtggataactacatgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagtgatgatagttccttcattgagatctcatatgatgctatgggtgagatcaaggactgtagtcgctatatggctcgggacactaattctggcagctcctcctcccaacagaactatgggctgcgagccaagagaaaagtcagatacagtgaagattatctatatgatgttgactcactagagggtgaaaaagtaaatgagaggaaggaatggctgccagttggttccaaagaggaagatgatgatgaatggtgtcccaaaaagagaagaaaagtaacccgtaaggagccccctgttattatcaaatatatcatcattaatcgctttaaaggtgagaagaacatgctggtgaagttgggtaaggtggatgccagtgagacaacagtgaatttgagtgagaatcagctcaacaaatatgccaagctggcacccttgaaaggcttctggcaaaagaagaagaagcagagaaacaccaacacggactccatcaagacacctttttcccaaaagcaaagctttgaaccaggtagctttgaggtgtcatttctgccacctgctcgcaaacgaaaatctaaacttggcaacaggcacaggattcaaagaatcccatccattgaaatttcagcaagtagtaaacagatttcattatgtaatgatcagaggcacgctagtaatcataaagaagatggaggcctaaaaggtacactgaagtcagcacctctgggtgctcctagctgtgcaaatggatcacatttaaatgacatcacaggccctgactcagtgaaagtcaaagcccaagacacagagtttaaggggccagagaggaaagtgctcaataaaatcaaatttaaaagtgaagctaggttaaaatctaagaaagtcaaagctgctgggcaagaaagcaagccaattgttcaaatgagccctctcttggaaaaccaatcctcaaaggctaatttaaagaatgaagttattcctgggacatcaaacagttcccgtctatctgaatttcatgaggcaaaggctgctaagagttccacttttctaccaacgacatgctcttctgaaatgcctttatcatctgctaatgttaccactaatatacctgttatcccgggagggtatctgcagacattgttagatgcttctgacttgtcaaataacactagtatctcatacttcagccaccattctccagagcaaaatgaaggcagcctcactcaaaccgaaaaatcatttgtacccctccagcctacccaggactgtgtgctcacctcatcctctgactctgagctgcagcagtcatctcataacttcaaaatggaatcaagcaactatagaaatgtgtggcccaacaaggctacttctggcacccaggaattcatggctgaagtctcaagggagatagccccaacccaatccagtgaatttggagcctcccaagtagtctccatggaaaataacctcacacctacaacatacaatccaatctgtctcaatagtggtggcagtaattgcaacaaggtcctgtatgactccatgcaagatacccaactcccatctgatgactcttaccaattatgtcactttaataatggagagatctgctttcctttccagcaggggccagtcaatatggatgatggtcggctctttagctttgattcaatggccccactctctgtcagctcaagtaattattgctccttaagcttgaagtcctgtgaaaaggatggcgatgatgatatcactgatgacttcctggcccattgcagccctaagctggtgatccagcaaagcattgatgagatagcaccactaaaggagtccactgacctcctggatatatccaacttcacccctgacaaattccgccactcttccctttcagagatgtccccaccggacacccctagtctttcccctcaaattaccagatgtgagagtatgaagacactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgagggattccgactacaatctcctaaaagcagaaacaaccttttgggttttacctgtgtttgaagaagagactcgcattttccagaaagacatttgatgtttgtgttttatttctttcaaaatatgccttgtggtatgtatgttgacatgtaagtgcttaaagaaaagaattttaaattgtgggaatacgtctttggagcaaactttaatctcatgttctatgtaaaagacttaaaaagtcatacagttgcacaagtagtttatgcactatttacccacaaggaaaaaattgaaaacattgtgccaaactacaaacaagtgactgtactgtatatatttttacttctatatcaacatttggttgtatttggggaagttgtccctgttaatttactagaaacattccagtgattcttgctattaaccacccccacttatgtggatagcacctgtagatcatggtggaaaaatatgttgtgttacacaatttaccaaaattaaaggatactgtttgaaatgtgccaaattttcttacctcatctcacagattcacccacagtttaaagctcattaattatttttaaatggatatatacacacccaaacatatatatgtatatgtttgtgtgtgtgtgtgtgtgtgtatatatatgtatatatatatatacacacacacacgttcttttaaagttttagactctactgtcctgtgtggaaacatgaacagctaaacaaggcaaaataaagattttcttgttccattgtgtaagggttaaaattttggaaaagtctgaaggccacaacagctaagtccatcagggacccaagtatatgcatttacagaacgttttacaaggaaacaaaacagctgctttcaaagtttgttttctaaaagcaaaatctgtagctgaaaattatttaaagtgcaaagttatattgctgatactttatatctcagttttatatattttataatagtctgggataaattataaaaatagctataaaatcaacactaatgataaatgaagtatatagaatgcttttatttaaatagtttcctaaatgttttattccagttttgtcaaaagtgcactcatatcatggctttagtgttctttcagtgtttaatcttgcaatgccaatgtcatttaaagaaaatgttaaggcatcccagttcaaccaaatttttcttcttatgagtaaagtacatttactatcagataagatgaacaatttgtggcaacaactgatttgggccatatacccttagtctgaggataaccaatatttgatgccacacactaaacttaaatctcaattttaagtacaaatttttaaatcacattttttattcagtactccccctactttttaaaaaaaatttcacagccccaacattcctcactactactttttcttcccttttattcaccacttgacttctaacatttgatctcttttctttgcacaattgaaggcctgtgcatctgatgactgatgcattatggcacagatgagataatggatgtgagagcgctttgtagatcataaagtgctatacagatataggggattaatattattaatattgttagttgttgtcgttgttactattcttattaatattgttactaacctattaacttgtgaatatataggctggggtgggagggtggagaataagtgggaagggaaaaaggggatttaacaaaaaaagggaagatgtttcaaaaggaaaattttaagcaaaatatgaacctacctagtcaatgccacctaaatgtattcacaaacagagaagcaacatttgaaagtagtcagagagaaatggaaggaagcctgtcatgtatataagtatatacacttcccggtccatgattcctttcaccagcctgctctattccttacagctgggtcgtaaaatgaacaagcctgtgttcttgatcatgtgtgttcccagcgtcagtctcttgtgtctgtggggatgagtgggtgaggagcattctgtgaggctggtacaggcccattcctaggctttaatgctctgtttgcagtgagccctggaaaattacttagtggaaaggcaccagatgaaacatgtctcctgccccatagctaccattcaaaagggaaaataaccaaactggaaaaccttcttctatttctctattctgatagctagctgtactaaatgctatggccagtccctagaaactggtctttgttttgtttttgtttttgtttttgatttttctgttttgcagctgaattttggcttggaatcaccaactctgcctgtattgtgatccccaagactccagacctcagagtcacctgctggcttagaggagtggagtgctttctatgtaatgaaaaggtggcaattaatgaaaaaataaagaaaatgttccattaatacaatgtgtttttataaaagtaaatatgggagcagttgtcccagttttttttcggtatcagttcagctttggagaatggggtgtgagtggggtaggacagcctgaaactgttggaaacaatttccttgtgagaacttgctatcataagtcctttggaatggatattctttcagttgctcctatggagcccattaagggccaattctagggcatagttcatccctttctccaaagagaattgttattttaaagtacctttttaattggcctgcagtgtattatatgtttttaatatataaattagtgacgcataaccagtcactttgtactgaaacataaaaagaaacagagtttgagaaatgagcaataggccgaggcagaagatgtttattctcttaattgcatttaatattcctctcagtacattgtgttctgagatgttcatcatttagcattttgttggtcctgtctctgctctcacagttctttttcttcctgtcataaccagctgccttagtagagtataaaaatagtgttttgccctatcactggtatctcaagtcagaaatatatattatccttggtctgaaattcctgattaccgctcccttctaaccttccccctctgagaagctgtttcctattaatgcctccctaacagagtcccatttaatctttactttcctggaaatggtaacctcccttattcttcttacttaatctcagaccttggtcttagaatttttcttttatggtctcatatcccacctgcccaaattgtcagggctcaacaatcttaggctgctttcttctggaagttcagaaggaaaccttcccattcttaattgcctttaattgctttggctattttcaaatctaattttttaattaaattttttttaatttttatagagtaggggtacaaggacagttgtgttacatggatatattgcttagtgttgaaatctgggcttttagtgtacccatcaccgaaatagtgtacattgtacccaataggtggtatttcatccctcaaatataattttaaacacacactcgtgcccacatggacaaattatatcacatgactgaggaaacttagaaattccttttccctgaagatctgttaagaataggtctcatctcctgccctggttaggtgctatattatatggagaagggtattgagactttgggggtcatgtttgggctgtgataactggcttgaaccagtgaccatcctttctgcctcgccaaggtctcttataccagcttcttcacatatgctgcttcctcccagctttcccttctgacttcttgttactctgcaactatgtgtcaaggccttaccttttcctgatgttttcaaacctcctgcattactttgatcatcacttcttcagccatctcactgaagtccttggtgctagctgggcttttgtgacaactttcaccttctctgaactttttccttgctgggaagcatctgcgtgtgtgagggggctacggagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgtttattttctcctttattattgagaaattatctaatttaaggagtaaccattttcatttagggatttttttaatgactgcccatcactacagaaatatgttctttttataaaataaaactaatgtgaggttggtttgttttctaatcataaaattcactaagcctatagttacatttagaagatttagtaccaaaatcaaacttttagtaacaaacaggaatcttgtcaacacaatgtaggccagggattttgtaaaggtttctcaaagacccaaataagggagaaaaaaattttagttgggctgtttaacttgggaaacactgtcatcagcttgagggtcctcagccagcatgtgattattttgatgacaggactcaggctaccctttaaggcacattttttactcagcattaaacactagctacagtcgtgaagcagagctcccattgcagctacatacttgagatgtactcttggtttcagaatcgtaactaagaggtaaggcattggagaaggacaatgtaaaagacagaggtttagaacaaagtttatggtgtgaatgaggctttcaaaatcagtatctgggtaaattgatactaaagacactgaagaaacactcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagtttaaaatactgctttagaatcatatgtattagaaatcaaaccatttctaattaaatctatgtcccaaataaaacgttctttatcatctagagcagtgtttctcaaactatctgtggtgagggaccaatagtttttgcaatccatcacagaccaatactattataaaacacaacaaaaatgaatttctaagaaagttaaatggaaaaaagatatgcaaaataaaagcccaaatgtattagatttaacatgtaaaattacatttcgagataaacataacataaggggaaagaaacgaattgcaaaaagttggtaccctgtttgagacaagtccactcatcaatgtcaaattgccatagaaggttctaatcatactttgaataatactttgactagaccagcagcattgccatcatctgggaacttgttaggaatgcgaaattccaagccctacaccaattctgctgaatgagaatctgaattttaacaagatccctaggtgttttgtgtgcatgttaaagtttgagaagcactgggctagagttttgtgtaggggattcttttgcccctcaaattgaggaatcatcttctagtgtgtccagtcttcaaagaccttaaaacaaattgtgtctttgttttgtgatccagatggaatctgcagagatgcagtcctctcaaagtgttaaagctgtttattgaaagtaataaatgctgatttgcctggt

SEQ ID NO: 24178 - DNA, 7226 bp, Homo sapiens
aaaagcggcctctcggctgagggccggggagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatc

SEQ ID NO: 24179 - DNA, 12180 bp, Homo sapiens
atgcattgcactaacccagctctgattttcttgatagatgagctctctccggaacagcacaacctttctttatactccatggagctcgtgctgaagaaaagcactgggcacagcgctgcacaagtggccttaacagaaactgctcccggctcccagcacagcagtcctctccatgtcacagccccgccgtctgccactacttttgatacagccttttttaaccaaggaaaacagaccaaaagtacagcagatcccagcatctttgtggcaacttacgtgtcagtgacgagtaaagaggtggccgtcaatgacgatgagatggataactttctgccagatactcactggaccactccacggatggtttctccaatacagtatatcacagtcagcccaccagggctgcccagggaagcattagaacctatgctcactccatcattacccatggtttctttacaagatgaagaagtgacatcgggctggcagaacacaacgcgacaaccagcggcatatgctgagtccgccagtcatttccacacctttcggtcagcttttcgcacctctgagggcatcgttccaactcctggcaggaatttggtgctttatcctactgatgcttacagtcatttatcaagcaggactctgccagagattgtggcttccctaacagagggtgtggaaaccaccctttttttaagctcccggtctttaatgccacagccgttaggcgacggcattactataccgttgccctccttgggggaggtctcacagcctccagaggaggtttgggccacaagtgcagacagatacactgatgtgaccactgtgttgagtcaaagcctagaagaaaccatctctccaagaacataccccactgtgactgcatcgcacgcagcccttgcattcagcaggacacattctccattgctttcaactcctcttgcatttgcgtcctctgcttcaccaactgatgtttcatctaacccctttctccctagcgactccagcaaaacatccgaattgcatagcaattcagccctccccggtcctgtggacaacactcatatcctgagcccggtgtcctcattcagaccatacacttggtgtgcggcctgcactgtgccttcacctcagcaagttctggccacgagcctcatggagaaagacgtgggatcaggggatggtgccgagactctgtgcatgaccgtgctggaagaaagcagcatctctctaatgagtagcgtcgtagcagacttctctgaatttgaggaagatcctcaagtatttaatacgcttttcccctccagacctatcgtcccactttcttctagatccatggaaatctcagagacgagtgttggcatttctgccgaggtggatatgagtagtgttacaaccacacaggttccccctgcccacggccgcctctctgtgccggcgtcacttgatcctactgctggctccttgtctgttgctgaaacccaagtgacgccatccagcgtgaccactgcatttttctcggtcatcaccagcattctccttgactcatctttctctgtcatagcaaacaaaaacacaccgtcgcttgccgtcagagacccgagtgtttttacgccttatagtctggttccttcagtggagtcttcacttttctctgaccaagaacgttccagtttttctgagcataaacccagaggtgctttggattttgcatccagctttttctcaacacccccgctggaactcagcggctccatctcttcgccttcggaagcacctgcgtctctgtctctgatgccgagtgacttgtcccccttcacatctcagtctttttctcccttggttgagacatttacattgtttgactctagtgatctgcagtcatctcagctgtctcttcccagttccacaaatcttgagttttcgcagctccagccaagttccgagctgcctttaaacaccatcatgttgctacctagccgttctgaggtgtcaccatggtcaagcttcccttctgattctctcgagtttgttgaagcgtctacggtttcactgacggattcagaagctcattttacctcagctttcattgaaactacctcctatcttgagtcttcactcatttcccatgaatccgcagtcactgcactggtgccccccggctctgagtcttttgacattttgactgccgggattcaagcaacatcaccattgaccactgtccacacaacgcccattttaactgagtcttctttgttctcaactctgacacctcctgacgaccaaatcagtgctctagacggtcacgtgtctgtcctggcctctttctccaaagccattcccactggtacggtgttgatcactgacgcgtacctgccatcaggatcctcgtttgtttctgaagcaacccccttccctctgcccacagagctgaccgtcgtgggcccatcactcacacccacagaggtgccactgaacacctccacggaagtgagcacaaccagcaccggtgctgccactggtggtcccctcgactccaccctgatgggtgacgccgcaagtcagagccccccagagagtagtgctgctcctcccctgccatccctgcgtcccgtgactgccttcactctcgaagcaacagtcgacacaccaacactggctactgccaagccgccatatgtttgtgatatcacagtccccgatgcctatctgatcacaactgtgctggccagaagagctgtgcaggagtacatcattacagcaatcaaagaagtactgaggattcacttcaaccgtgcagtggaactgaaggtttacgaactatttactgacttcacttttctggtaacatccggtcctttcgtttacacggcaatatccgtcataaatgtgcttataaacagtaagcttgtccgtgaccagactcctttaatcctgtctgtgaaaccttctttccttgtgccagagtccaggttccaagttcaaacagtacttcagtttgtgcctccgagtgtggatactggcttctgcaacttcacccagcgcattgagaaaggcctaatgacagctctctttgaagtgagaaaacaccaccagggaacgtataacctcacggtgcagatcttgaatatcaccatcagttcctcaagggtgactcctcggcggggcccggtgaatatcatctttgcggttaaaagcacacagggatttttgaatgggtcggaagtgagcgagctgctcagaaacttgagtgtggtggagttcagtttctatctgggatacccagtgctgcagatcgcagagcccttccagtatccacagctcaacttatctcagttgctgaagtcctcttgggtcagaacagttctcctgggcgtcatggagaagcaactccagaatgaagtgtttcaagccgagatggaacgcaagctggcccagctgctcagcgaggtttccaccagaaggcggatgtggagaagggccactgtagctgcagggaacagtgtggtgcaggtggtaaatgtgtcgaggctggagggagatgacaatccggtacagctcatctactttgtggaggatcaagatggagaaagactcagtgcagtcaagtcttcggacctgattaacaaaatggacctccagagagcagccatcatcttgggttaccgaattcaaggtgtcattgcccagcctgtcgacagggtgaagaggccgtctccggaatcccagagcaacaacttgtgggtcattgttggcgtggtcatcccagtgctggtggtgatggtgattgttgtcatcctctactggaaactatgccgcacagacaagctagactttcagcctgacactgtggccaacattcagcagcgtcagaagctgcagatccctagtgtgaagggcttcgattttgctaagcagcatctgggtcagcacaataaagacgacatattgattattcatgagccagcgccactgccaggacctctgaaggaccacaccacgccctcggaaaatggagacgtgccaagccccaagtcaaagatcccttccaagaatgttcgtcacagaggaagagtttctccctcagatgctgactctacggtcagtgaagagtccagcgagagggacgcaggagataagacgccgggagccgtcaacgatggcaggtcccacagagctccgcagagcgggccaccactgcccagttcgggaaatgagcagcactcatcagcctccatcttcgagcacgtggacaggatctcccgccccccggaggctagccggcgggtccccagtaagatccagcttatcgccatgcagccgatcccggcacctcccgtccagcgcccctccccagccgaccgagtggcggaaagcaataaaatcaacaaagagattcagaccgcgctgcggcacaagtctgagatcgagcaccatcgcaacaagatccgcctgcgcgccaagcgccgcgggcactacgagttcccggtggtagacgacctgtcctcgggcgacactaaggagcgacaccgggtgtaccgcagggcacagatgcagatcgacaagatcctggaccccacggccagcgtgccctccgtgttcatagagcccaggaagagctcacggataaaacgttctcccaagcctcgccggaaacaccaggtcaacggctgtcctgccgacgctgagaaggaccggctcatcaccacagacagcgatggcacctacaggaggccccccggcgtccacaactcagcctacatcggatgcccatcggatcctgacctcccagccgatgtgcagacaccatcctcggtggaactggggaggtatccagcccttcccttcccggcctcccagtacatcccaccccagccgtccatcgaggaggcacgccagaccatgcactccctcctggacgacgcctttgccctcgtggcccccagcagccagcctgccagcaccgcaggtgtaggccccggagtcccacccggcctgcccgcaaacagcaccccttcccaggaagagaggcgagccacccagtgggggtccttctacagcccagcccagacggccaacaatccctgcagtagatacgaagactatggaatgactcccccgacgggtccattgccaagaccaggttttggccccggtttgctgcagtctacagagctggtgccccctgaccctcagcagccacaggcctccgccgaagccccatttgctgccagagggatctactcggaggagatgccgtcggtggcccggcctcggcctgtcgggggtaccacaggctcccagatccagcacctgacacaggtggggattgccagcagaattggagctcagccagtggaaatcccgccaagcagaggcagccagtatggggggccaggctggccttcgtacggggaggacgaagcggggcgaagagaggccgtgccaaggacttcaggcagggagccctcagctccttccgggaacctcccccaccggggactgcagggccctgggctgggttaccccaccagctccacggaagacctccagcctggccactcctcggcctctctcatcaaagcaatccgcgaggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtattttggccaaaagccagcagcacttcacaaaaacaaaacacaaacctaagctaacaaaatgactgcattcgtctcttttttaaaggtagagattaaactgtatagacagcatagggatgaaaggaaccaagcgtttctgtgggattgagactggtacgtgtacgatgaacctgctgctttgttttctgagaagaggtttgaagacattttattaacagcttaatttttctcttttactccataggaacttattttaatagtaacattaacaacaagaatactaagactgtttgggaattttaaaaagctactagtgagaaaccaaatgataggttgtagagcctgatgactccaaacaaagccatcacccgcattcttcctccttcttctggtgctacagctccaagggcccttcaccttcatgtctgaaatggaactttggctttttcagtggaagaatatgttgaaggtttcattttgttctagaaaaaaaaaatccctcccaaagtggggcaaaaagctttatatttatttgattatccaaaatacagatcaaagtttagatctacattcttcattgtatttgctgtttcttaattgggcacacacaactcctggtcatgtcccagttcagcaccgatcgctaaggccgatcctgtagaatgcggctttcaagaggtcctaactgatcctttcttccactttgctgttgatttgttcacaaattatgtctgaatgagaaatcttctgtaagcagaagttatttaataattcccagcaccacgaaattgttatacatacatccctaccagtcacattccctgtgttcagagcctggaaatgaaattgagttcagttcagcctctctgtaatgaatcaagaaatgtaaaagagctttgagaccccaagggaaaggagagagttgcttctcatttctgattttattgtgctgttactctgtcgagtggctattaaaattgtcttatgctctttgggctaagaggggatcatctcgcttaagatgtactcctgatgtaaacatttcccccactttccaaataatggtaaagaaaacagtggcaagggctgttctgttttctggtacctgagtgaaactcagaagaaaagcaggcttagctaagagattttcactattaacctgtttttattagatcagcgaagacagtcatgcatcgcttaatgatggggatgcattctgagaaatgtgtcattaggctgttttgttgctgtgccaacatcctagattgtacttacacaacctacatggtatagcctactacacacctgggctgtgtggcatggcctattcctcttaggctacaaacctgtacagcatgttactgtactgaacacaatggtaagtatttgtgtatctaaacatagctaaacatagaaaaggtatggtaaaaatacaattttataatcttatgggactaccatcaatatgtagaccgtcattgaccaaaacatcctgatgtgtgcatgactgtacttttcattaaataacagataaggggctatagaatttggggctctgactgatcaaaacctgtgtatctgtgtcaagttttaagacccctgaaacagctaaaacaggtttccaaagtgtaatcactggatttcaaaaccatgttttagcccttcattaatgaagcctgttgtacagatttagagtcttacaatatgagggaagttggttctgggaaggtaagatgtagccagttttcatctgggcacctctgaaagagaaggagtgcaggagagtaagtctctcaaggacgttcaacaaaggaccagcagcatcttatcaggcgatcctcagaggctccaaggagcattggagagaatgcccctttctgggcttgatgtcttggttttggtttaataccaaatttctcttggtcttggtttaatacccgactcctcccaaattgaacgattatctttgtatgtcactcaaaaataccaggtttcctgaatatgttattaagaatttcagatatccaagcagaattttattatggacaccttgtaatgaattcaaatcgtgtgacagcaaacgggataaatggccccttctcacccagttccgctcagggccatacaggcttgcacatagagtgtgctaaaaatggtaacctcctttgagcattgcagaaagagggttctgtttcaaattgggctgaccgtaaaagcaattttgatgtctttcaaactaccataaagggattttaactgtatttttattcttagaaacaatacacctttaaacagatgtcaagaccaaagatgatgtataataaacagccggtggttatggtgtggtgtgagcaggcccccggatcaccagccctctgctggtggtcataaagcacacacagtttgtacttgcttcctctcgacgcctgccacaacagttttgccagtcaccaaactcagaaaaaactagctgtgtgagcagcaccgtaccctagcggtcttcagacattaagttcacgtcatccactgaaaggaagggtccttgcgttgacagcgtgtggctttggagtccgtttatggaagcactctacaatgaacagttgaattttatgtctattcttttttcctattttaaaagttctagtggtaacacaaactgtaaatttgagtcagaatgtttggagaaatgttgtttttttttttttcagagactactttgtcactcactgaccatgtctggttccttctctgaacttcattctccccataagccaaacaagaacagacctcccccgccacctcccaggcaccgtagttgtgagaatcagatgtgatcatgtgtgcagatgtcctgtgaggagggagcataaagcactgtgaaaatgtagcatgctgtctatgtggacgccctaggatgagtgatgtgaaacgctgcactactgcggtgaatgggttcacacatgggtaatgagcaaaaccgaaagctcggtgtgactcagtttcctcactcccattttgctttaatttcacttccttcaccaattttccgattgcatttattaagcatctttctgctcccgactttctggtgtctctggcaccaaataacccagcagacatgagccttgccttctgagattttagaatctaagatagcacgagtgggtatagaagatggaagataccgataaataacatggtttaagtgtcaataaaattcattcgaagagatcaggcgcggtggctcacgcctgtaatcccagcattttgggaggctgaggcaggtggatcacttgagatcaagagcttaaaaccagcccaggcaacatggcaaaaccccgtctctacaaaaaaatacaaaaactagctgggtgtggtggcgcatgcctgtagtcccagctgaggcacgataattgcttgaacccggggggtggaggttgcagtgagctgagattgcaccactgtactccaacctgggcgacagagcaagactgtgtctcaaaaagaaaaaaatttgttcaaaagacataaatgaattaggcacccagaagaagttgcatgtttggaaatgcaatatcttggggagacgtcaacttctgaagtgactttgaaggcagggcagctacccaggcaaatggcgtggaaggaagagctgagagtgggcctgggaaaggctgtagggaaggagtgaagctgtcactgaaatgaacttgatcttgatctgctttgatatggggacagaatccccgactgcactattgagggagtttcagaagagaaggaagaggtgctggaaggatgcttttgcagtcatgcagcaaggaaacgaccagggctgtgaagatctacagaggaagtactccagtgtgggggaggcaagggaagaggacgaaaatgatgagaatgacactgaggtcattgtttagagcagatctcaagcagccgtttggccacgccatatcctttgtggagcatagtgggttatctatctgtctgtctgtctatgtatctgtctatctatctatatatatattcagcttctttactgctacctacacatttttctccaaattttattaatttcatagtgttttgatttgggtggcagatgacttttaagcagtgggtgtttgccggccagatctttcctggcatgcggactgtgaggcaaagcacgggtgaaggtaggcgctaaaggctttgggctaaagccagcacgcggttctgtgctataggagtctcccgtttcccgtggacaggttcagcgttccttctttcgcacaacttttttctaagtgttccagtgaccaagccagtcattcggacactgatttgcagtgcattggcagtaattcacaaattagttgttatataagtctctctcatccctttcacactagattctcagacatgaatgaatttgtcgtttggaaggaaagctgggtaacgttttgggcacaggggaaggaggactccggtcttaactcccacgctaactttagctcaagtggagttttcaccgtggtcatttctacctccggagcaaggtgccagcgccagtactagagcctgcttatccacatttgccctggacaggagcaggaggaagtccacttctgtaccggcagacagagcatgtgaacacaaaacacatttctatggcatagtcaactgaacttcatttttacatttaatctaacatgttaacacgttctaacagggtttctatgagcagctgctgtaacatactcatcaactatgatagacttaacacttgttacctaatgaacaaggaggatgtgcatttcgggtttcttttgatattcgtggaggtgattgtcagtgtttaaacaggactactttctccactatgaagatgacttggaaatcgcaacatcatggtacattgctaagtccatgcttgtgtgtgtgacagtaggcttgataatttatcttaaaacacagcagcattgaaatttaggaaaagaatattaaatgcctttggaaacatgaaacaaagttaggagccagtaagaaagtgacagaagcaatgaatgtcttaatgcagtatagttaaaatggcttcccacagggtagataattatccaggatccttccttttccttcttcctccaggtttttcaggggtcacttcacatttctaaagaaagagtgaataggctgggcatggtggctcaagcctctaatctcaacgctttgggaggctgaggcaggaggatcgcttgaggccaggagtttgagaccaccttgggcaacataacgagaccccgtctctacaaaaaaaatttaaaaattagctgagcatggtggcatgtgccagtagtcccagctactcgaaaggctaagactggaggatcgcttgagccaatgagttggaggctgcagtgagctataatcacgccactgcactccagcctgggctgcagggtgaggtcctgtctctggaaaaaaaaaaaaaaaaaaaaggaataggtaaaagggacagaggtgaaattttgagtgacttgagtctcttgcagtccctgattacacagaacctttctgggctacttggagcatcacgaatagtctttcctgtacttaccagatttcaagtattcataacttgactccctaagtgtacaagttgggaatagtacagggccaagttcaagtcgcatatgctgtactgttcctcctgcaaatgtggggaaagaagagggagatactagaggaactgaggctccacccattcattcagttgctctaagcaccagaggacttgtttcagaaaaggggagtgggaacgccctcgactttgccctcctccggagcatctctgggacgcagggagtctggctagcgttaataggaaaggttgctcggcagagctgccctggagtactgacttgtctctccctcctttgtcaaggtccatgtttttctggctcttcctgcacactcatccctagattatgagcgttaatgtacgaaatgtgcagagcaaattgaggccaactgtggcatcaatactgcaacttaaacttgacaatcatggtttgctggtcctcaaacaggcactgaaatctcagtatgggtatacgatttaataatcggcccctcccttctatttgtcggttttatgtttctatccttcaatagctgcactgttttctaatgtgctgtagagtttttgaaataatttatgcaagtatttggtttccatgtttacaatttatacagctttcctagcattttaaatggaaatgtcaataaatgctatgaattggtgtcaaa

SEQ ID NO: 24180 - DNA, 7351 bp, Homo sapiens
gcagcagccgagtctgacggcgccggttcgctgcccggtccgcccgcgatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagaggggatgctggagaggaggaggagaagagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggcgggcaagggatgcaggcaggacagccatgaggtggggctgcagccggcacacccagtggtggagggccggcgctgccactcacggtgggtggccgtgggccaccttccctgcaatgggtgcacacgcggctcccatccagccctctcagcgtggggctgtggctggtcctcactattccccagtctcccgctgtggggcaggaacaggaagtgacgggaaccttgaggaggaaacgcctgtgttagggagagagtgggtgcggtgtagaggatgctcttggccggctggagcaagacctggctcccaccagagggacgtgtgtgtgcctgcagacggcccgggagctgtgtgtctccgccagagtcacagcagtgccgaggtgtccgcggcagaccacacagaccgtctgaaatgcgcccgcctggcggacagctcccttctgaagcagagaagcctccatggtcacgaagcagcgttgtgctgtgtgtccctcgcaagaagcacaggaaagagaagtttctttagtagccactagacaaccaccctttctgaaagcaaacagtgctgctctttattccagacaaggcaggaaagtctgagttgggagtgacagtggctggagagaagcagatctgtgcaacgtgcagggcaagccagtggcgtggcctctgcctctaagcgctgagcattgggccccttccccaccagacctttgtagctcctccagcctctgcagagactcccttcacctcgcacttactgcctgggaaccacggcccttctcttctgtgggtctgtaccaggtactccaggccagcccatgggcccggggcctgaccccaacacctgcatgctgggtccagagccttctgtttcaccgtgcgtggacactgctaggccgcctggggtcccctgcctcctgcctgtcgctgccgtggtccctgactgcgaaataggcccgcggggctctccctcctcctgccatcctcccctcccgcccttcctggctacctcctctgacatgcggtcagataagtcccgtcttgtttgtgagtaccacagaaacgcctgagagtcacttacccggccactgcttggaaggtttccctccggggaatgcctccctggaatgttccagagacggaacattctctagagacaacagtctgtgctgcagattggttggatcacagaatgtgtgtctggggcattatctgaaacgtggtgtcatctgatgcatttggaccatatgctgccagactgcagaacgggggagccggggctcagggcccctgactgcatggtgcatgagtgatctcagcctagcgatgccgctggccagaccgtgaccatgctgccagtgtgctcgccatgagctgggtcagggctggggagttgtgcaggctggggtgacccttcccccatcattgggccccaacgggcatgtctccaccgaatccatttagagaaatgtcagagcgagggttgtgtggacacccctcgctctgatgccaactgcagataatacacacctcctgcagcgtccagccacggctccagggcactgctctcctccttgcaccggtgaaactcaggccacactcaagggctgactgtccaggcgctcccttcagccgcctcgtcgtcagcgttcttagtcatgcattattcgtgttagctgaaatgcattcagactttgttctgcggtgcccacaggacttacccctgtatgtacaggatttttgtatgaaagttttgtttgattctgagactctcttgggaacgctggagagcttgtgcacagcctctggaaggaaaggcagcgctgacttcgttgggcttttttccaagcactttaacttcagaaatggtcttgacacttttttctccacatagactcttgaaatagccatttcaggggaggaaagggttggggttttctttgtttgtttgtttgtttccccctttactacctgttcttgtagatctagctcctcagagttggaggaaggctgacagagaaggtctcctctgtgctccatccacacaggatgccggagagacagccccttgtgctgtgagcagagcaggcagtggctctggaggctgcctgtggtctccttccggctgtggctgacagtggctctggccagggttgcttggagaaggctcagtgtgcctgggacagggcttaccacctgccaccaaggtttcctctcttcccccaggacctgggcagagcaggcatgagctgggctgtggtgcagagcaagcagacccagccacactgctcaaaggtccctgcgtggggaggtgtcacaccaggggcacacccagggccacctgggtgtaggagagctctggtggcccctccgtaaactcaggaagtgtcaggtgatttcctagggagaggttcccagtcccagcaggcagaatgcccaaaaccaggagcacgaaggcctgtcatccatggggccattgcaggcactctgccgcccgaccttgagggctgtgccaatcctagtgaaccaaaatgcaaacaactcacacaagtgaaaagctccctgctttgaaaacaggacatgttgacaggcagcatggtatgtttttagcctttgttacagttttagcaacattgatgtctaagaggggccgtggtaatagattgcatctgccctgtgcatgcgcatgtttaaccacaggccagagaactcaattctgatgtcgtaagttctctgtaagtgaaatggggtagactgtatgattttcctattgccaaaagaaagaaagggggccaaacagctctgaaatttccaaaaaatggctagagggagagtccagtttctgagctctgtacccaaattaaaatcctgatgttcaggttaatccaagcaacacgcattgggtttaaaaccagcaccgaggcccagtgggggaatcacagacatcaccaagtctcgtcttctttccttcctgtgagttgaaaccaaacaggcctctcgctcactcctcccagcccagtaatgctgaggagttcagttgtgaggaaagaaggctggagctgtgagattcgcttttccctaggctgttccgcgtgggttaccttatcaccctggagcacttggtattccagacccctgacatgaggaatgcaggttcacactgtaaagagtttgtgaaaggtttcagtctaactggggttccttagctggaagccagggctggaagctacaggcctgaccttcctgggtcccactatctgttggcattttttttttttttttttttttagacggagttttgctcttgttgcccaggctggagtgcagtgacacaatctctactcactgcaacctccacctcccgggttcaagcaattctcctgcctcagcctcctgagtagctgggatgacaggtgcacgccaccacgcccggctaatttttatatttttggtagagatggggtttcaccatgctggccaggctggtctcgaactcctgacctcaggtgatcccccccacctcagcctcccaaagtgctgggattacaggcgtgaggcatcacacctgcctctgttggctttttagttaggaaggatccagctaggcccgtgtggttagatcagctttgttactgaattacctaaaaccagaccacagcacagccagggagcccagtagtgtttccaagaacagtgtggagcttgagaaagagaactttaaaaattagagggtccctttctgcagaggaagggatgctcgcagggtggcagtggcccagccccagcctcagggacggggagggagagccccctctgggcccagcaggcaggtgttctgaggctggtccctcctcagtttccgcagccacaaggcgaaacggccagattctcactcaaggtcgttctcactccttttcctgtcccgtttccagtcccactgagccattcacttctgctgaaccatttttcttaggatgcagccgtctcactcccttgtcctgtaaatcgtgtattcatgttgatgattcttggagataggtttcactttttcccagctgcgtccacaggaaaggggagtcggatgccagctgcaccccgcctggctcgcacaggctaagaccacagacagagcagggcttcccggagccacacaggccacgcaccccaggaacccttgctgccgcgggccaggaacaggaatgtgttggtgcctgagacaccaaatggaagaagcacatcaagactgttctcctgcggccaacactggcccggaagccgccctccatacaggccctcagggggcctgccttctgcgcctcagtcccccgtgcatccctgggcctgggtatcacatgctctccaggaaagggacggaatcaatcctgtgaccgatgggctcgcaaggatgggtgccgccgtgggagccctgcctctggtgctggcaagggattgggtttgtgtgggtgtctctagcctgcagagtgcagtgagtgagagtccttgggagcgcggcgctgcctgtagctgtgcctggggatgcacgtggccacgggatttcagtgggacagcgctcccacaggggctgggggtgggggtggggtttcttagttactgttggaaagggaaaaattcaccatatccaaggggagagacgatgggctgggtttgtttactccaacttcccttctacacccctcctgcaggacagtacgatttggggagaacccagctccccactttatctgcagactctgggacctgacaaaacagtcagagcctgagtgcactgcagcctgaactcccttgagcagcgctataagggactttgcactttaaaaaggggatgcctgtcagtaaatcccctgtgcattgactagaactggggggctgcgcccgctccctccttaatcctagatgatttgctcatgaaatagaggtgggggacgaccgcatgcactctgggaggtgcagccctaaggggtggactccagatctccctgcaagagacagcttggcttggctttggctgttggggaggagtccctgccatcccggtgagcctggggctgttgcttagggtcttctgggtggacacgtggagaaagagaaggcaaacgttggaacactaggaaaagctagaaattcagacaacacacatggatccccttaaaacatgtaaatgtgtcagaacacggttgacctgccgccttcttgaacctggtggcccccgttggaactatcagtggcgtctcccatgcacacgccctctgctttctctttcctagactcgcggtgctcacatccagacattaccttgttggtagcccccaagtggcgtgcagtgacaccagtatcttctctgttgcatttttgcaatcttgtgtcccgctcggtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaacttt

SEQ ID NO: 24181 - DNA, 15896 bp, Homo sapiens
agtgccgcccggcctcggttgggacccctcccctcctcctccgcccccttgggtgtcggtggctgcggccagggtctggacctgggcggcggccccgggcggcggggctaaagggtgtgggcaccggcagagcttcgcaggctgcatccggctcggtgctgctgccgtcgccgcccctgccgccgcccaaggccctcggcgttccccggagagaggccagagggatttcgggctgcctcggcactcgcccaggtttgttaagatgaaacactgcagaaaggctatctgaagaaaagtagaaggaaaaacagaacgttgcaaactctggaaaaaaacttgggcctttagatgttgttctggaaaaactttagtaatggatcaaaggaagaatgagagtattgttcctagtataactcaattagaagattttcttacagaacacaattccaatgttgtttggctccttgttgctaccattttgtcctgtggatggattatttacctcacatattataattcccggaatgttggtcttattttaacactagttcttaacagattatacaagcatggctatatccatattggttccttctctttctctgttctttctggaaaagtcatggttcgtgaaatctattacattacagaagacatgtctattaggattcaagatggattcatcatttttcggtggtggaaaatgtataacccaaaacagaagcaacatgatccaaaggcagaaaccaggttatacatcacagtcaatgactttgaatttcatgtctataatcgctcggatctttatggacgccttcaagagttgtttggtttggagccaacaataattccacctaagaaagatgatgataaaacacgggaaattggaagaacaagaacccaatcgaaaattgaaagagttaaagtaaaaacagaatcccaagaccccacatcttcatggagatcacttattccagtcataaaggtcaatgtgagcacaggacgtttggcctttggaaatcactaccagccgcaaactctgtgcatcaactttgatgatgctttcttaacttatactacaaaaccaccttcaagtcatcttgaccaattcatgcatattgtgaaaggaaagcttgaaaatgttcgagtcatgcttgttcctagtccaagatatgttggtcttcaaaatgatgaaccaccgagattaatgggagaaggttttgtggtgatgcagtcaaatgatgttgacatctactactacatggatgagccaggacttgttccggaagaaacagaagaaaatattgaaggagaaatgagcagtgaggattgcaaattacaagacttgcctccatgttggggactggatatagtttgtggtaaaggaacagattttaattatggaccatgggccgataggcagagagattgtttgtggaagtttttctttccacctgactatcaagttctgaaagtttctgaaattgcacagcctgggagaccaagacagatccttgcttttgaattacgaatgaatattattgcagatgctacaattgatttgctgtttaccaaaaatagggaaacaaatgctgtacatgtaaatgtaggagctggctcatatttagaaattaatattccaatgacagttgaagaaaatggttacactcctgctattaagggacaactcttacatgtggatgccactaccagcatgcaatatcggacccttttagaagcagaaatgttagcattccacatcaatgccagctacccccgaatatggaacatgccgcagacatggcagtgtgaattagaggtttataaagccacttaccacttcatctttgcacagaaaaacttctttacagatttaattcaagactggtctagtgacagtcctccagacattttttcatttgttccatatacgtggaattttaaaatcatgtttcatcagtttgaaatgatttgggctgctaatcaacacaattggatcgactgttctactaaacaacaggaaaatgtgtatctggcagcctgtggagaaacactaaacattgatttttctttgccttttacggactttgttccagctacatgtaataccaagttctctttaagaggagaagatgttgatcttcatttgtttctaccagactgccaccctagtaaatattctttatttatgctggtaaaaaattgccatccaaataagatgattcatgatactggtattcctgctgagtgtcaaagtggccagaaaacagttaaaccaaaatggcgcaacgttactcaggaaaagtctggttgggttgaatgctggactgtcccaagtgtcatgcttacaattgattatacatggcatccaatttatccacaaaaagcagatgaacagctgaaacaatcattatcagaaatggaagagacaatgctatctgtattaaggccatcccagaagacatcagacagagttgtttcttctccctctacttcttcacgcccacctattgatccctcagaacttccacctgataaacttcatgtagaaatggaactttctccagattctcagataactctctatggacctctactaaatgcctttttgtgtataaaggaaaactactttggggaagatgacatgtatatggattttgaagaggttatctcaagtcctgttttgtcactgtcaacatcatccagctctgggtggactgctgttggaatggaaaatgacaaaaaggaaaatgaaggttcagccaagtcaattcatccacttgccttgcgtccttgggatattactgtacttgttaatttgtacaaagttcatgggcgtcttcctgttcatggaactactgatggtcctgaatgccctacagctttcttggaaagactatgttttgaaatgaaaaaaggatttagggagaccatgctgcaacttatcctgtcacccctgaatgtgtttgtcagtgataactatcagcagcgaccccctgtggatgaagtactcagggaaggtcacatcaatttgtcaggtctccagctgagagcacacgctatgttctcagcagaaggtcttcctttgggaagcgattccttagaatacgcatggttaattgatgtgcaggctggaagtcttacagctaaggtcacagcaccacagctggcatgcctcttggagtggggacagacatttgtttttcatgtggtatgtcgggagtatgaactggaaagaccgaaatcagttataatatgtcagcatggaattgatcgtcggttctgtgaatccaagttgagttgtattcctgggccttgtccaacttcagatgatttgaaatatactatgattcgtttagcagtagatggagccgatatttacattgttgagcatggttgtgctacaaatataaagatgggtgcaattcgagttgcaaactgtaatctccacaatcaatcggttggggaaggaatcagtgctgcaattcaggattttcaagtgagacagtacattgagcaattaaataattgcagaattggacttcagcctgcagtgctacggagggcctattggcttgaagctgggtcagccaatttaggacttattactgttgatattgctttagctgctgaccatcattctaaacatgaggcacaaagacatttcttagaaactcatgatgccagaactaagaggttgtggtttttatggccagatgatatcctgaagaataagaggtgtagaaacaaatgtggttgtctcggtggctgcagattctttggtggcacagtaactggcctagatttcttcaaacttgaagagttgacaccttccagtagctctgcattttcaagcacaagtgcagagtctgatatgtattatggacagtctctgctacagcctggagaatggataattactaaagaaattcccaaaattatagatggtaatgtgaatggcatgaagaggaaagaatgggaaaacaaatcagtgggaatagaagtagagagaaaaactcagcaccttagtcttcaagtaccattacgatctcatagttcatcctcttcctcagaagagaacagtagttctagtgctgcacagcctttgttggctggtgaaaaggaaagtccttcatctgttgctgatgaccatttggttcaaaaagagttcttgcatgggacaaaaagagatgatggccaagcaagtatccctacagaaatttcaggaaacagccctgtgtctcctaatactcaggataagtcagtaggtcaatctcctcttagatctcccttgaaacgacaagcctctgtctgttccacccgtcttggaagtactaagagtcttactgctgctttctatggggacaagcagcctgtaacagttggagtccagtttagtagtgatgtctctcgaagtgatgagaatgtactagactcaccaaagcagaggagaagttttggttcattcccatatacaccatcagcagactctaattcatttcatcagtatcgatcaatggattccagcatgtcaatggctgatagtgaagcctacttttctgctgctgaggaatttgagcccattagcagtgatgaaggccctggaacttatccgggtagaaaaaagaagaaaaagcaaacccagcagattgactacagtaggggttccatatatcacagtgtagaagggccacttactggacatggagaaagcattcaggattccagaactctgccattcaaaactcatccttctcaggcttcatttgtttctgcgttaggtggagaagatgatgttatagaacatctatatattgtagaaggtgagaaaacagtggagagtgaacagattactccgcaacaacccgtgatgaattgttatcagacttaccttactcagttccaggtaattaattggtcagttaagcacccaaccaacaaaagaacctctaaatcctcattgcatcgtccccttgatctggatacaccaaccagtgaagaaagttcatcgtcatttgaacagctttctgttccaacttttaaggttatcaagcaggggctcacagctaattctttgctagacagaggcatgcaactttcaggatcaacttcaaatacgccgtatactccattggaaaaaaaactcgctgataacacagatgatgaaacattaacagaagagtggaccctggatcaaccagtgtcccagaccaggacaacagccatagttgaagtaaaaggaactgttgatattgttttgactcccctggtggctgaagctttagacagatatattgaagcaatggttcattgtgctagtacccgacatccagctgcaattgtagatgatcttcatgctaaagtcctcagggaagctgtccaaaatagcaagactaccttttcagaaaatttatcttccaaacaagacattagaggaacaaaaactgagcagtctacaataggaacgactaaccaaggacaagcacagacaaatcttacaatgaagcaagataatgtaacaattaaaggtcttcagactaatgttagcataccaaaggtaaacttatgtttgttacaagcctcagtggaagaatctccaactacggctcctagtaggagtgtgactcatgtttccctagtggcattgtgttttgacagaattgctacacaggttcgcatgaacagaggtgtggttgaagagacttcaaacaatgcagaacctggtagaacatcaaattttgataggtatgttcatgccacaaagatgcagcctcagtcatctggatctctcagatcaaatgctggagcagaaaaaggcaaagaaattgcagctaagttaaacattcatcgagttcatgggcaacttaggggtcttgatacaacagacattgggacctgtgcaatcactgctattccttttgagaagtccaaagttttatttactcttgaagagttggatgaatttacttttgtggatgaaactgatcagcaagctgttccagatgtaactcgaataggtcccagccaagaaaaatggggatggataatgtttgaatgtggacttgaaaatttaaccataaaaggaggaagacagtctggtgctgttttatataacagttttggaattatgggtaaagctagtgacacagaaaggggtggagtgctgacatccaataattcttctgattctccaaccggcagtggctataatactgatgtctctgatgataatcttccatgtgaccggacaagcccttcctcagacttaaatggaaattctgtttcagatgaacaggatgaaggagtcgaatctgatgatttgaaaaaagatctacctctgatgcctcctcctccagattcatgtagcatgaagttgaccattaaagaaatttggtttagttttgcagctcccaccaatgtgagatctcacacacatgcattttctaggcagctgaaccttttaagcactgcaacaccagctgttggtgcatggcttgttcccattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacatttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatggtatgaaagatagtgcaacatctcctccttctcctcctttaccttccactgtccagagcaagactaacaccttacttcctccccagcccccacctattcctgcagccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaa

SEQ ID NO: 24182 - DNA, 7610 bp, Homo sapiens
agcggcgcgcgccgaccgcggcgccaattggcgagcggctggagcgcggggtttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagctgtaaactcatctcttttccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaaaaaagaaagaaagaaaatgaatctgccacgccattgcttagaccctttaatgactcttgagtgttcttgggatgaggtccaaatttactaataaggcctgcaaagccctgtgtaattttgctcctagttatggctggcatctgcaccacaactacagccactgccacctccccctgccacacacacattttaaaagtaacaatagtagtgttttctgtgttttgcatatgcagtcttttctcatctcccagccttcttgagcttttcctctgcctgagatacgctcccactcacatagacattgggggcactaaataaaaatagctgtttaattgaattggaatcgttccacttggaacccaagtttggaaattttgctacttcttgttaagctaggccttttattcttgaagttgctatttctcatacaaactcattttatgcattagacacacagtcactattgttatggagaacatagttgtatcagaagaggtatagctttgggtgtggatgtgcgtgtgtcaggggaaagatattctgattatatgatgattttcataaaatatagtatgctgagtttccgaaaatcctaaatgacttagaaatggtgctatatgtggtttgtttgacccctgcaaatctcatgttgaaatttgatccccattgctggaggtgttttgagcatggagcggatccctcatgaatgtcttggcgttgtccttgcagtaatgagttcttgctctatttttcctcccctggaagctgattgtttaaaagagcctggtatcctccctccctttcttctttgcttcctctctcttgctgtgtgatctctgcacacaccagctcccctttgctttctgccatgagtggtctgaggctctcaccagaagccaagcagaggctggcaccatgcttctagtacagcctgcagaactgtaagccaaataaacttcttctttgttttttttttttgtttgttttgtttttttttcagtaaattacccagcctcaggtattccttaacaacacaaatgggctaagacacagggtcatagggatagcaggcacctgagccaagccagaacttagatctcaactgttaatgcaggatgatttgtattgaaccatgaattttacactgcctctcaatgttggtgtcagcatttaaggttatttaaaaaatacaacctgaaggttacataaagtttcatttaaaaaataagaccttataagtctacttttatttccagtggacagcaactacttaatcgtcttaaaactttcttcttacaatattactttacaatattacctgttggatttattatctgtgtacaaatcagttagttgaagggccaaagaataaaggcattttgtgaattatgaatagctattttgaaatggtcatggagactagctactctagaaaattgggagaatatactgtattaagttactatctggtataacttcaattaattgtgaaaattgtagcagagatctagatatagtttatgaacttctaaagagacattaaagggaattcaagtacttgtgtaaagatgaaccaaggtagagatgattgtgaattggtgatctgctgtatgttacagttatgtaatttgacttgtttcaaaattattaaagttttaagtgtatgcattctactggtcaataagtaaatatattcaggctctgaatgtagacagataaatatataaatatagaaagtacatttgttagaatacaaacaagaataaaaattgagtacagaat

SEQ ID NO: 24183 - DNA, 3955 bp, Homo sapiens
aaaaaaagcgcggcgaaagctaaaggccggcgcacgctgggcggtggtggtccctaagccgggccgcggccggtgcaatggactccactgcctgcttgaagtccttgctcctgactgtcagtcagtacaaagccgtgaagtcagaggcgaacgccactcagcttttgcggcacttggaggtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacatttaacacaatagctgtctcataaaaaatctaagaacttgtagaattatttgtaaggtatatttagtgtttttttctcttttttcaaatgttgcatagtggtccagatcatctataattaattataagtttcttatgatttacataaggataatttggattctactcttgctgcatattcagaaaaatattatttactgttaattctgatatgaattgtatttaatttgttgtcctaatagtttttaattggttcatttaattttaaagcataggttaaatatctttattttttttaaaatacaagggtccttctgtacttttcatttgaatcatatcctctaactactctgtaagaaacgtttttacatcaatattttgattgattttattgctataccaatacagtcattaattttacttggtgttttcttcaccatatgtctgtttgatttaagtgaatttagatttgtacagttctggaaattttttaaaaaatattatgcagagtaaaacattttaaatt

SEQ ID NO: 24184 - DNA, 5932 bp, Homo sapiens
atgcttgaaggcaattaccaggtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcattatgatccaatttatgttttttctttgtttatattttggggaaaattaaaatttttttaaggtatatttttcccattatttattttcctgaccttaaaacagcttttctactaaaaaatggtgagcaatgaagacaataaatttttcatttttccataggttatcttctcttgatttaaatttcaggaagagttagcatgtgcttgggttatctagatttataattgcctttgaaattccatcctcgttggagctggtaagaagggcttgactgaaagtttgaaggaatctaaaaaacaaaaaagtaagaaaggtaacgagaagccctaattctccattaatgcaaactagctgctagtatcatagaagtcaaatgacttaaaacagtttatgtagtgctagaagtataattaaagtaaataggaaagcttgtcaatcaaatcactggcaaaatcatgaagaagagagtgagaaggtttgtctataagtacagatgactgtatgaaatactggggtaatttcatggtctccagaaaatgtcagtgggacttttgttctttgtcaagcaccagaggttatatggttatttttctgctgcaagactttgaggatgttgactttctcagaaactttttaaaaaaataatccaataaggcaggaattcagttttgaaaaattacatataattgtattcataataagaatgtggttatttcataagcagttatgaaagaattattgttcttattcaaaagtgatccagataattgtgatattttctatggtgggctactggtattagcacgacttggatattatttgttgaaggaagtatgaatgaagttggatttgaccaatttcgtgtaaaccttaattgatttaaaactgggaaagaggggggtttcctggccattgctgatctaaggtgctcttatttgtttccaataaacagtaatctttatagaccttaatgcagatttaaaaaaatagttgtgattggctgagagaggcagggcatatatgtagggaaatgatttgccccaagcattccaatgaagtatgacttgtaacttttgtgtctgaaggtggtgtctttatttttgtggaaaatgggagaaaaatgaataattgtgtttatttggctgattggtaatacactagaccattctgttattattgaatgaatgttttgtgtatatctctgctgttgcacatatgagtataggtgaggttgtcattgtttgctctgggattcagggagggagtcactttgcataaacctttttttgcatttaatttcttgaatgttcttataaagaagacattatgttggcattcttcatttttatcctgccaacagagtgcttatgagcatgtctgcattttgatcaaaatttaaacagaagagtgaaaatacatttgaaatgaaccctttcagaggaaccctggcaaagctgtatagactggacagagtgagaaaacttccacagccacctgtcacctttctcctcatcttccactgtgttcaatatgtatgttccaagccatagagataattgggattttctcccaggtagcttctttcttctcctgtcactggactaaaatctctgacatgtcaaaaatgccttaaattttaatgaactctccgaaaatgtagttgatattggagaatttattttatttctaattttagatattaaatatattttgtcagcacagtcccatctttgggaaggaggtgattttttcccttggattccagtggtttgtcattttatttcaagcactgaagaagtatgacagaaagaatattatggggaaaatatttagaccaatcctggctataaaatttcctttagttttatgcctggcctttgcaaagctcagtgaaatgttgaaaggaataaattaatcatgtttctgtgacttttgattgacacttgttccttttcccccctaagtggtagaagaagttatttgttatttttctaaaaggcacaattttgaagccttaactacttcattaagtcaactgttgcctataacatctcttagcactcgtcaaaacgtatttaaatcaattttccaatggatgagaacatgtcttctgtggataaattatattatgtcatttaacaacattgagcattttgatatgtgttcactgaattaaaaaacctgaatttcattattgttgacttttcccctctttagttactagtaatcacatcctttctaggattaaaaatatttcatagtatttttgtgtagatgtctgtccttattttcttcccaaagaaaaaaggttgtttaaattgattatgtggaagaattacttgggtccagtctttagcatctggggtctccaggtccccaggtgggtcatgattgactgcttcttcaagacccatcttgccaactctcacttgatgtctgtcaatagaactacttcctgtggcacatggttatttctaatgggaggctaatgtgtacataatttctctcttcctcatagaaataaatttctctgggggttgctgtgagaggatgacttcattagccatgtttaaagtgagtgtactgctcacgtttatctttgtacactaagagtatgtagagttgatcttcagagaaactaaacctccctcatatctatttatagtaatcatgaatatgattgcagttgacaggcccaactcctaaactgagtttgcccaaagaaaatgtccttagaggagtaaacttttagaaatctcaacacccgactcattcgttggaagctaaaatggaattcatcttcatactaactggctacagattattctcttgctggattttacttttattttaacatttttacatgagttccttttagaatcataaatgaaagaagtaaaactttaagatgggaatgaataattgaaaagagaattatatttactattataattgatattattcgctattatgattacacttgtctagatcagagcccagcaaacattttttttgtaaagggtcagatagtacatagttttggctttgcagggcatgtgggctctattgcatttactcaactctgccattgtagtatgaaagcaaccacatacaaaatgtaaatggatgggcgtggctgcattccaataaaactttatttatggacactg

SEQ ID NO: 24185 - DNA, 1511 bp, Homo sapiens
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctcaaaaaaaaaaaaaaaaaaaa

SEQ ID NO: 24186 - DNA, 4853 bp, Homo sapiens
gcacttccgctccccagttgccgcgggatggcaagccggcgtgggggaagggagaggtcggcggagacgagggagggaccatatccgggagagcggcagcttccgaccagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggttttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtc

SEQ ID NO: 24187 - DNA, 4187 bp, Homo sapiens
agccgtcgccggcgagtggtcacatgatgcccctccctgctcccagccgcttcggtcatgtgaccgcctggggagtcaggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttagatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtacccaaa

SEQ ID NO: 24188 - DNA, 2901 bp, Homo sapiens
tgacgcggtcccggaagttgaccggggtgcggagctcctgggctgcagctcctggagtttccgaggttcgtgcgcgtctggtggcggcggcgtgatgttctcggcaggagcggagagtttgctccaccaggccagggagatccaggacgaggagctgaagaagttctgttcccggatctgtaaactgctgcaggcggaggacttggggccggacaccctcgactccctgcagaggctcttcctcatcatctcagccacgaagtacagccggaggctggagaagacatgcgtagacctgctgcaggccaccctcggcctgcctgcatgccccgagcagctccaggtgctttgcgccgccatcctgcgagagatgtccccctctgacagcctcagcctggcctgggaccacacgcagaacagccggcagctgagcctggtggcctccgttctcttggcccagggtgacagaaacgaggaggtcagagccgtgggccagggcgtgctacgagcgctggagagccggcagcctgagggacccagcctcagacacctcctccccgtcatggccaaggtcgtggtcctcagcccgggcaccctccaggaggaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtgctctccagcggccaccgcttcacagacgaccagtggctgaacgtgcaggccttctctatgctgcgggcgtggctgctgcacagcggccccgagggcccgggcaccctggacacagatgacaggtcagagcaggagggctccactctgtcggtgatctccgccacctcctctgccggccgcctgctgccgccccgggagcggcttcgggaggtggccttcgagtactgccagcgcctcattgagcaaagtaaccgacgagccctgaggaagggggactccgacctgcagaaagcttgcctggtggaggccgtgctggtgctggacgtgctgtgccggcaggacccgtccttcctgtaccgaagtctctcctgcctgaaggccctgcacgggcgggtgcgcggggacccggcctctgtgcgggtgctgctgcccctcgcccacttcttcctgagccacggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaagttcctggcctggaacagcccacccctcacctccgagtttgtggcgctcctcccggccctggtggacgctggcacagccctggagatgctgcacgcgctgctggacctgccctgcttgacggcggtgctggacctgcagctcaggtcagcaccggctgcatccgagaggccactctgggacacctctctcagggcccccagctgcctggaggccttccgggacccgcagttccagggtcttttccaatacctgctgcgccccaaggccagtggcgccactgagaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtgtgggccatcggcgagtacctgtcggtgacctacgatcggaggtgcaccgtggagcagatcaacaagttcttcgaagccctggaggctctgctattcgaggtcacccagtgccgcccctctgctgccctgcccaggtgtcccccccaggtggtcaccgtgctgatgaccacgctgacgaagctggcctcccggagccaagatctgatccccagggcctctttattgctgtcaaagatgaggaccctggctcacagtccagccaccagctccacgcacagcgaggagggcgcggaagccatccgtacccgggccacagagctgctgaccctgctgaagatgcctagcgtggcccagtttgtgctcacacccagcacggaggtgtgcagcccccgctatcaccgcgatgccaacacggccctgcccctggccctgcgcacggtcagccggctggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctcctttaataagcgtctgtatgaa

SEQ ID NO: 24189 - DNA, 7297 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagagaaaagcttcattctggaggggaaggagttttgagtgccaaggatgaaattccacccatcactcggtctctgagctgcaggacacaggcaggacaacgggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatc

SEQ ID NO: 24190 - DNA, 2534 bp, Homo sapiens
ggccgcaacgtgtcgagagccgtaagtaaagtgtcgcaaagcagaaggaaggcgggagtcccgactgcaaacattgaggaaagccaggcagtagaggccgctatggcgaacgttccgtgggcagaggtctgcgagaaattccaggcggcgctcgctctgtcgcgggtggaactgcataaaaatccggagaaggaaccatacaagtccaaatacagcgcccgggcgctactggaagaggtcaaggcgctgctcggccctgcgcctgaggacgaggatgagcggcctgaggccgaggacggcccgggtgccggtgaccacgccctggggctgccggctgaggtggtggagcccgaggggcccgtcgcccagcgagcggtgaggctggcagtcatcgagttccacctcggggtgaaccacatcgacacggaggagctgtcggcgggggaggagcacctggtgaaatgcctgcggctgctgcgcaggtaccggctctcgcacgactgcatctctctctgcatccaggcgcagaataacctgggtatcttgtggtctgaaagagaagaaattgaaactgcacaggcttacctagagtcatcagaagcactatataatcagtatatgaaagaggttgggagtcctcctcttgatcctactgagcgttttcttcctgaagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataagctatgctttatggaggccaggcactgtttatcagctgctaatgtcatttttggtcaaactggaaagatctcagccacagaagacactcctgaagctgaaggagaagtgccagagctttatcatcaaagaaagggggaaatagcaaggtgctggatcaaatactgtttgactctcatgcagaatgcccaactctccatgcaggacaacataggagagcttgatcttgataaacagtctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcagaatagccatgctagagcccctaactgtagacctgaatccacagtattatctgttggtcaacagacagatccagtttgaaattgcacatgcttactatgatatgatggatttgaaggttgccattgctgacaggctaagggatcctgattcacacattgtaaaaaaaataaataatcttaataagtcagcactgaagtactaccagctcttcttagactccctgagagacccaaataaagtattccctgagcatataggggaagatgttcttcgccctgccatgttagctaagtttcgagttgcccgtctctatggcaaaatcattactgcagatcccaagaaagagctggaaaatttggcaacatcattggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctaaattccccccacccaaaatctttcccttttgaaaatactaaaaactaagttatgttattataaagtgtaaaatggtttgtcttaattataggagaaaaaggccttgttagaaataaaataaactgacttatttcactaatgaaaa

SEQ ID NO: 24191 - DNA, 11759 bp, Homo sapiens
ggggggacgaggcaggggaagaacctgggaaggaaaaccagtagcatcagcagcagcagcagcagccgccgccgccaccaccgccgccacagcagtagcattagcggcagtagcagcatttagcaatagctttaacagctatagcgacagtagcagccgccctcctctctccctctcgcggacggccgcagccaccgcacagagcgggctccaggcgccgagcgcgcagcccgctcgctaggtagctccagccggggcgagcgacagtgtaagcgaagcacggacccttggagcagccgggcagccgcggaggctctgagtttcagggccagagcccgacagctctgactccatctagcgcggcggcggcggagcctgagggagcgagcgaggagagaggcgcgtccacctggcgggcccagcgtatggagctgaggcagaggcggcggcggcggcggcagcagtagcagcggcggtggcggctaaggcagctcgaacagctgcggcgacggcgacagcccagccttgactgcgaccgcgctagctacagcgcctgctgcctgagcccgccagcgacgtgcgcctcgggagtcggcctgtgaggtgttggacagcatttggacttggaatgaaacaataagaggttatattcatggataaccaacaagataaggctattgttgcctcagccaacggagaaaacactctgattaatggggtcaaagaaaatgactcagaggaccaggatgtggcaatgaagtcatttgcagctctagaagctgctgcacctatccagcctacaccggtggcacaaaaagagaccctgatgtatcccagaggtctcctgcctctaccctctaagaagccctgtatgcagagcccgccctctcctttgggcctgattgaagcacccgaacatgctgctaatagtgcttctgtgaatgccatctccctcacatctggcattgcaaaaggcctgaacacatggtcacttcccaatgaatgtgagaaagctccatttgccataatggagcctgcaggcatgtcagctctgaatggggactgtctcatgcagccaagtcggacttgcttaggctgcttcatggaatccaaggatgcagtagatcctgagccagggatcagtctgaaagttggtgatctaaatagggattatgaaacgtgtgcagtctctgatatagggattcagtgtattaatgctggagaaaatatgaaatatggagagcagctgctctcagaccagctcctaggcttccccctgcataagtcaagggcaggagacagacgagaaactgagaaacctgacattgacttggaggatccggctcagaaaagctattatgaggcattactgttagacaagtgcaatacagaagaagctttgcttgcaaattccaatcaggattggggttacttcgagacttttattagtgaaagtaagattgaactgcttgacctctgttccaaaaatgagctgtctgtcaacctattctctgaagaagatgtggataactacatgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagtgatgatagttccttcattgagatctcatatgatgctatgggtgagatcaaggactgtagtcgctatatggctcgggacactaattctggcagctcctcctcccaacagaactatgggctgcgagccaagagaaaagtcagatacagtgaagattatctatatgatgttgactcactagagggtgaaaaagtaaatgagaggaaggaatggctgccagttggttccaaagaggaagatgatgatgaatggtgtcccaaaaagagaagaaaagtaacccgtaaggagccccctgttattatcaaatatatcatcattaatcgctttaaaggtgagaagaacatgctggtgaagttgggtaaggtggatgccagtgagacaacagtgaatttgagtgagaatcagctcaacaaatatgccaagctggcacccttgaaaggcttctggcaaaagaagaagaagcagagaaacaccaacacggactccatcaagacacctttttcccaaaagcaaagctttgaaccaggtagctttgaggtgtcatttctgccacctgctcgcaaacgaaaatctaaacttggcaacaggcacaggattcaaagaatcccatccattgaaatttcagcaagtagtaaacagatttcattatgtaatgatcagaggcacgctagtaatcataaagaagatggaggcctaaaaggtacactgaagtcagcacctctgggtgctcctagctgtgcaaatggatcacatttaaatgacatcacaggccctgactcagtgaaagtcaaagcccaagacacagagtttaaggggccagagaggaaagtgctcaataaaatcaaatttaaaagtgaagctaggttaaaatctaagaaagtcaaagctgctgggcaagaaagcaagccaattgttcaaatgagccctctcttggaaaaccaatcctcaaaggctaatttaaagaatgaagttattcctgggacatcaaacagttcccgtctatctgaatttcatgaggcaaaggctgctaagagttccacttttctaccaacgacatgctcttctgaaatgcctttatcatctgctaatgttaccactaatatacctgttatcccgggagggtatctgcagacattgttagatgcttctgacttgtcaaataacactagtatctcatacttcagccaccattctccagagcaaaatgaaggcagcctcactcaaaccgaaaaatcatttgtacccctccagcctacccaggactgtgtgctcacctcatcctctgactctgagctgcagcagtcatctcataacttcaaaatggaatcaagcaactatagaaatgtgtggcccaacaaggctacttctggcacccaggaattcatggctgaagtctcaagggagatagccccaacccaatccagtgaatttggagcctcccaagtagtctccatggaaaataacctcacacctacaacatacaatccaatctgtctcaatagtggtggcagtaattgcaacaaggtcctgtatgactccatgcaagatacccaactcccatctgatgactcttaccaattatgtcactttaataatggagagatctgctttcctttccagcaggggccagtcaatatggatgatggtcggctctttagctttgattcaatggccccactctctgtcagctcaagtaattattgctccttaagcttgaagtcctgtgaaaaggatggcgatgatgatatcactgatgacttcctggcccattgcagccctaagctggtgatccagcaaagcattgatgagatagcaccactaaaggagtccactgacctcctggatatatccaacttcacccctgacaaattccgccactcttccctttcagagatgtccccaccggacacccctagtctttcccctcaaattaccagatgtgagagtatgaagacactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgagggattccgactacaatctcctaaaagcagaaacaaccttttgggttttacctgtgtttgaagaagagactcgcattttccagaaagacatttgatgtttgtgttttatttctttcaaaatatgccttgtggtatgtatgttgacatgtaagtgcttaaagaaaagaattttaaattgtgggaatacgtctttggagcaaactttaatctcatgttctatgtaaaagacttaaaaagtcatacagttgcacaagtagtttatgcactatttacccacaaggaaaaaattgaaaacattgtgccaaactacaaacaagtgactgtactgtatatatttttacttctatatcaacatttggttgtatttggggaagttgtccctgttaatttactagaaacattccagtgattcttgctattaaccacccccacttatgtggatagcacctgtagatcatggtggaaaaatatgttgtgttacacaatttaccaaaattaaaggatactgtttgaaatgtgccaaattttcttacctcatctcacagattcacccacagtttaaagctcattaattatttttaaatggatatatacacacccaaacatatatatgtatatgtttgtgtgtgtgtgtgtgtgtgtatatatatgtatatatatatatacacacacacacgttcttttaaagttttagactctactgtcctgtgtggaaacatgaacagctaaacaaggcaaaataaagattttcttgttccattgtgtaagggttaaaattttggaaaagtctgaaggccacaacagctaagtccatcagggacccaagtatatgcatttacagaacgttttacaaggaaacaaaacagctgctttcaaagtttgttttctaaaagcaaaatctgtagctgaaaattatttaaagtgcaaagttatattgctgatactttatatctcagttttatatattttataatagtctgggataaattataaaaatagctataaaatcaacactaatgataaatgaagtatatagaatgcttttatttaaatagtttcctaaatgttttattccagttttgtcaaaagtgcactcatatcatggctttagtgttctttcagtgtttaatcttgcaatgccaatgtcatttaaagaaaatgttaaggcatcccagttcaaccaaatttttcttcttatgagtaaagtacatttactatcagataagatgaacaatttgtggcaacaactgatttgggccatatacccttagtctgaggataaccaatatttgatgccacacactaaacttaaatctcaattttaagtacaaatttttaaatcacattttttattcagtactccccctactttttaaaaaaaatttcacagccccaacattcctcactactactttttcttcccttttattcaccacttgacttctaacatttgatctcttttctttgcacaattgaaggcctgtgcatctgatgactgatgcattatggcacagatgagataatggatgtgagagcgctttgtagatcataaagtgctatacagatataggggattaatattattaatattgttagttgttgtcgttgttactattcttattaatattgttactaacctattaacttgtgaatatataggctggggtgggagggtggagaataagtgggaagggaaaaaggggatttaacaaaaaaagggaagatgtttcaaaaggaaaattttaagcaaaatatgaacctacctagtcaatgccacctaaatgtattcacaaacagagaagcaacatttgaaagtagtcagagagaaatggaaggaagcctgtcatgtatataagtatatacacttcccggtccatgattcctttcaccagcctgctctattccttacagctgggtcgtaaaatgaacaagcctgtgttcttgatcatgtgtgttcccagcgtcagtctcttgtgtctgtggggatgagtgggtgaggagcattctgtgaggctggtacaggcccattcctaggctttaatgctctgtttgcagtgagccctggaaaattacttagtggaaaggcaccagatgaaacatgtctcctgccccatagctaccattcaaaagggaaaataaccaaactggaaaaccttcttctatttctctattctgatagctagctgtactaaatgctatggccagtccctagaaactggtctttgttttgtttttgtttttgtttttgatttttctgttttgcagctgaattttggcttggaatcaccaactctgcctgtattgtgatccccaagactccagacctcagagtcacctgctggcttagaggagtggagtgctttctatgtaatgaaaaggtggcaattaatgaaaaaataaagaaaatgttccattaatacaatgtgtttttataaaagtaaatatgggagcagttgtcccagttttttttcggtatcagttcagctttggagaatggggtgtgagtggggtaggacagcctgaaactgttggaaacaatttccttgtgagaacttgctatcataagtcctttggaatggatattctttcagttgctcctatggagcccattaagggccaattctagggcatagttcatccctttctccaaagagaattgttattttaaagtacctttttaattggcctgcagtgtattatatgtttttaatatataaattagtgacgcataaccagtcactttgtactgaaacataaaaagaaacagagtttgagaaatgagcaataggccgaggcagaagatgtttattctcttaattgcatttaatattcctctcagtacattgtgttctgagatgttcatcatttagcattttgttggtcctgtctctgctctcacagttctttttcttcctgtcataaccagctgccttagtagagtataaaaatagtgttttgccctatcactggtatctcaagtcagaaatatatattatccttggtctgaaattcctgattaccgctcccttctaaccttccccctctgagaagctgtttcctattaatgcctccctaacagagtcccatttaatctttactttcctggaaatggtaacctcccttattcttcttacttaatctcagaccttggtcttagaatttttcttttatggtctcatatcccacctgcccaaattgtcagggctcaacaatcttaggctgctttcttctggaagttcagaaggaaaccttcccattcttaattgcctttaattgctttggctattttcaaatctaattttttaattaaattttttttaatttttatagagtaggggtacaaggacagttgtgttacatggatatattgcttagtgttgaaatctgggcttttagtgtacccatcaccgaaatagtgtacattgtacccaataggtggtatttcatccctcaaatataattttaaacacacactcgtgcccacatggacaaattatatcacatgactgaggaaacttagaaattccttttccctgaagatctgttaagaataggtctcatctcctgccctggttaggtgctatattatatggagaagggtattgagactttgggggtcatgtttgggctgtgataactggcttgaaccagtgaccatcctttctgcctcgccaaggtctcttataccagcttcttcacatatgctgcttcctcccagctttcccttctgacttcttgttactctgcaactatgtgtcaaggccttaccttttcctgatgttttcaaacctcctgcattactttgatcatcacttcttcagccatctcactgaagtccttggtgctagctgggcttttgtgacaactttcaccttctctgaactttttccttgctgggaagcatctgcgtgtgtgagggggctacggagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgtttattttctcctttattattgagaaattatctaatttaaggagtaaccattttcatttagggatttttttaatgactgcccatcactacagaaatatgttctttttataaaataaaactaatgtgaggttggtttgttttctaatcataaaattcactaagcctatagttacatttagaagatttagtaccaaaatcaaacttttagtaacaaacaggaatcttgtcaacacaatgtaggccagggattttgtaaaggtttctcaaagacccaaataagggagaaaaaaattttagttgggctgtttaacttgggaaacactgtcatcagcttgagggtcctcagccagcatgtgattattttgatgacaggactcaggctaccctttaaggcacattttttactcagcattaaacactagctacagtcgtgaagcagagctcccattgcagctacatacttgagatgtactcttggtttcagaatcgtaactaagaggtaaggcattggagaaggacaatgtaaaagacagaggtttagaacaaagtttatggtgtgaatgaggctttcaaaatcagtatctgggtaaattgatactaaagacactgaagaaacactcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagtttaaaatactgctttagaatcatatgtattagaaatcaaaccatttctaattaaatctatgtcccaaataaaacgttctttatcatctagagcagtgtttctcaaactatctgtggtgagggaccaatagtttttgcaatccatcacagaccaatactattataaaacacaacaaaaatgaatttctaagaaagttaaatggaaaaaagatatgcaaaataaaagcccaaatgtattagatttaacatgtaaaattacatttcgagataaacataacataaggggaaagaaacgaattgcaaaaagttggtaccctgtttgagacaagtccactcatcaatgtcaaattgccatagaaggttctaatcatactttgaataatactttgactagaccagcagcattgccatcatctgggaacttgttaggaatgcgaaattccaagccctacaccaattctgctgaatgagaatctgaattttaacaagatccctaggtgttttgtgtgcatgttaaagtttgagaagcactgggctagagttttgtgtaggggattcttttgcccctcaaattgaggaatcatcttctagtgtgtccagtcttcaaagaccttaaaacaaattgtgtctttgttttgtgatccagatggaatctgcagagatgcagtcctctcaaagtgttaaagctgtttattgaaagtaataaatgctgatttgcctggtacccaaaa

SEQ ID NO: 24192 - DNA, 9265 bp, Homo sapiens
gcggcggcggtggcggcgcgaggcggcatgagggagccgctcgtgctgggtcctgccaccaccatggttccagtggttgagctttgctgaagcccaggcatcatgtacagtgtagaagacctcctgatctctcatggatacaagctgtcaagagaccccccagcatcacgcgaggataaccccaaggggcgccaggcagcgaggactgggacacgagcaggccagggcctgcagaacgggcatgaggatggccctgcggccctcgcacatcgtaagacgtccgcggggaaaggacatgtgagtgactccgaaagccgccgcagcacaccgagaggccacggggagccccagagcacttctgcttccagaacctcggaggcggggttttgtaatcaacccccctcagcatggtcctctcatcccccgactggtaacgaccaagcctaccggagaagaggacggcaagaagccaggagccagaagccgagggagcacgaaaacctggaggccagaggaatggcccaagcccacagcctgcctgtccacgtgagggagggtccatgggaagttggaggaaggtcagagcatgtgatgaagaagccagtttgggaagaagaattgcgaatgtcaggtcctgccaagtggcagaacgtcagcctggaaagctggaaccagccaaggaaattagggaggcagatgtctgatggagatggggagagactgtttcaagacctgtacccattcattcaaggagaacatgtgttgaattctcaaaacaaagggaagtctcgctcactgcctagagttctttcccccgagagcctgagttgcacggaaattcccattccattaaatgaaagacattcacctaaaatgccaccgtatcctcccacttgcgcaccaaatttggactccacgaggaattctgagaagagtggctgctcagccccatttccccggcctaagtttgggaggcccctcaagcccccatcttacagctcgcaccagcagtctaggggaggagcggacagcagtgactctcaggacagccagcagatggacgcctatgtccccaggcatgagctctgcctgtcagaccctggattggaacctccagtgtacgtgcctccgccctcatacagatcgcccccgcagaacatcccaaacccctacttggaagacacggtgcccataaatgtgtgtggcggtcacagtcaacagcagtctccgaccgagaaggctggggccagcggtcagcctccttcaggcccccctggaactgggaatgagtatggtgtgagcccccgcttgcctcaggggctccccgcacatccccgacctgtcactgcctatgacggcttcgttcagtacattccctttgatgatccacggttacgacattttaaactagctcagccccagggtttctgtgaagacataaagcttgacgataaatcatataactccagtcctgtcactgctcaagagccggctcatggaggaatgcagcctgatggtgccatttggaatccacagagcttaatacccccgtcgggggatgagagaggcctggtcttggccgattccagcccccggtggctgtggggccagccccccggggatggggaaaacagtggcctccccaaccagagagaccgctgtgtggcaaggggacagtggcctgatgtgagaggcagccagcacgggcacactggaagacaagtttcctccccttactcacagggcgagagcacctgcgaaactcaaaccaagctcaaaaagttccaaactgggactcggaccaagaaaagttcaaagaaaaaaatgaacgagactatattttgcttggtttctatcccagtgaaatcagaatcacatctgccagatagagatatggacaacaatgacttaaagcccagtgctgatcaaaagaatgggtctgataagagcccggctctgcaagaacagagtctgctgagcatgtcttccaccgacctggagctgcaggccctcacaggaagcatgggtgggagaacggagttccaaaaacaagatctaggggaaccagaagaagacagacaaacaaatgacctcagtttcatccaccttacaaagcacagagaactcaagcattctggctcttggccagggcaccggtacagagatcagcaaacacaaaccagtttctccgaggagccccaaagttcgcagctgctccctggtgcaaagctgggagggccgagtcgtgcagcattgagtccaaaatgttcagaccctgctgcctccgaagctcagacgcacacagcattccctaccggtgatcacaaacagaggccaagtgcccgtaacctgaaaggtcacaggtccctcagcccatccagcaacagtgcgttctcaaggacttccttgtccgtggaccaggcaccgacgccaaaagcaggccgaagtcagccctgcgtggatgtccacgggcttggagcccaccctgggcctaagcgggaggtggtgaagggggagcccacgggcccttgcaacagtaaacaactctttgggcagtttctcctgaaaccggtcagccgtcgtccctgggatttgatcagtcagttagaaagttttaacaaggagctccaggaagaggaagaaagcagcagtagcagcagcagcagcagcagcagcagtgaggagagtgaggcggagccgcagcaggagaaccgtgctcactgcagacaggaggatgtgggcttccgcggaaacagcccggaaatgagggttgagccacagccgaggatgtgggtgccggagagccctgtgtgtaggtcgggaagaggtgagagtaagtctgagagctggagtgaggagctgcagcctggccacccacgtgcctggcctccatccccgggccgctttcgcgtggaagaaggtggcggtgcacctttctgctcagcagatggaagcacgagtgcagagaagagacacctggaggttagcaacggaatggacgagctggcaggtagcccatttcctgtgacgagaatgtcttcaagatcaagtgacgcaaaaccactgcccgcgtcctatccagctgaacctagggagccccaggaaagtccgaaaatcaccagtgctttcagctctgtgaaaccaagtgaagcggtccctcggaagtttgacagtggtggagagaggggggcagggctcccactgtccctgtctaacaagaaccgagggctctcagctccagacttacggtctgtggggctcacccctgggcaagaacagggtgccagtgagctagaggggtctttgggtgaagcaagcacaatagaaatccccccaggtgagtccttgcaagccagggctgcaaggatcctgggcattgaggtggcggtggagtccctcctgccgggcatccggagagcgggacagaaccagcctgctgagcccgatgcaagtgcctgcaccccagagtccccccaggaagagttgctatctcgcccagcaccggcagatgtccccagggtgtccactgatgccttttatggcaggaggaagtgcggctggaccaagagccctctctttgtaggggacagggacagtgccaggcgggctcctcaggcttttgagcactcagatgtggacggggttgtcaccagcacagaccctgtccctgagcctgagcccagccccttggagtccaagttcttcgaacaaaaggatgtggaaacaaaaccacccttcaggtccactttattccattttgtagaaagaaccccaagtgtggcaggctctgaaaagagacttagaagcccttccaaagtgattgaaagtttacaagagaaactggcctccccgcctaggagagcagaccctgaccgcctgatgagaatgaaagaggtgagctcagtgtcacggatgagagtcctgagcttcaggaatgccgactcccaggaggacgccgaggaattgaaggccaccacaaggggccaggccgggctcccgggaggccttgtgtctcctggcagtggggaccgtgcccagagattgggccactcactctctgtgtccaaggacagcatctccagggaagagaaggagcatccggcagcacaaaaggagaagagcatggatcaagacttctggtgcccagattcctatgaccctagcagagtggagagggtgtgatgaaatgccggtggagcttgcattccgttgcgaattgagtattctcaagtagctggtagatttagtctatcagccccacttccccatgtagaagctggaagctgctgagtttttagcatcctgataacattctttaccactgccactaggaaacttgccatcctctcagaattgctttgtggcgataaagcaatcgtccgttgaaaccatctgtttttatagcatgaagatttaatgcctataattaggaaggagttttcacagaaaccctccctcatgacagatttgactaagctggtaaatagtttggtgttgctctcattctgggtgaagatttcaatgtggaagatctagcaaatgctttggaaaggcctgtgaatggtgtgctcccctctgtgtctccatggcctgcagtccatgctcttgtgaaggagtttgggacactggctgttgcccggtgtttcagcactttcagtttaggggaaatgtgaatcaataggtatgatccatttctaatcaatttggccttctgctgctggaagtaactttacttataagtaacttgccatcagagaataaaagcaatatcttttaagttcctgaaaaattaaaacttgtactgtaatatactaagagtattatttatctggcagtgaaatattttgatcatttgcaaacacgccattgtctgctttgcactcagtattatctatttttattttctgtatgggtatttagaaattctttatatgaaaaataattgctggtttaaaatagaccattttaacaaagtgactatatttctttttacgaaaatgctatttttctatgatgtaaacaattgttaggcggcagatttttaaggaagtattattttatttaagagtctgtatccctttgtgtgagaggaacccaaagagggttcacttttgctttaaagctctgtcccttacccactgacaactctgctacttttattttatcttagaaaatgtcaatatagacatatcacagggttaataaaagaaacttttcacaaagatttttgtacaagtgtagctatcaggttatatttgaaaataaccctctgaaaaccagccaacattgtcatgacaatttttgctgccgtatcaactagaattaccaaaaaacatagttttatctttgtatgtgtgtggggatctaccctgagaccatgcttttcttcccaccctgccaccccacccctttaaagaaatacgtatttttatctagaatgatcttgaattagtctctgcatatttttagaaagtgcttggggacattatatatatgccattacaaaagcattatgaggcctatgtattctactgtgtttaatactgcattaacctgcacaaagtttatgcattttttcatgcatttttttccttctttctaagtaaggtattcctgacaactaacattccctaaatcatttcccctccctccctccctccctcccttcctttcttccttccttctgtcctccctcccttgctacctcttgccctccttccttcaccctgtcctccttttcccttttattttttccccttctctttcattttattttcttttagagaaaccaccttatctatttttagacatttcgaattcctaaaatgtgaaccgttgggtgatctgtcctttggccctaaaacggctggccgggctgtcccggcctgttctcatctgtaccgtatgattttatttcataataactttatgtatttggactgtaacaaacaaaacagaacctaagtcgccccgaaaaatctttccaagccttttcaaaacacttatctgcagtccagaattcagctcttatgaaaagtgagagtgcactccagttttcacagcagcaataagtgcgggaaacaaaaagatcctcttcccaggaaaagttgagtggggaagagttcagacactgttgtagctggtgaatcattgaagtcacctggtagtaccaaataagggctgaggcgcctggaggtctttgtggggtcttccctctttaaatgcaaacgtaagaaggtatatgtgtatatacatttatatacgtgcacatgtatactcgtacatgtatgcacacatacccatacatgtatatgaactccgttctgatttcctctgaaattttgttgataccatctaaatacctctttgaatcaaaataacttaattttagctcattcctcaagagaaagagaaggatccccaaggaagaaaaactgttgtaccttctgtgattctcaaaccaaaatgtgatgcgcttctgttttgttatcttaaattgttgtatcatatctttctgaaaccattctgaattaagttgaaattttcaacatttatactttaactgttctaaatttaagcctacatgtaaatcttttttggggggaaggtaacttgaaaagtttaacttgaaaatttgacctttaaactttcatattctaaggtaaataatagcctataaccaacaacagctttcccagaggtcttgaatttaacactaattgtttagttattgtttctatttctcatacatacataacttcgttttttgtggctggaagaaaaagtttctatattttgtatttgtctttgttcttctcatgcacacaatttactgttggtgtttaataatttggagctcataaaattaaaagttgtaattttgaccatttgggctaaaaattatatgagggattacatatgcaatggattagtatttcttgatttgcaaaagaagggaaaatgatggtaatttagctcaaattgcctttctttgaagaaaatttctgaatgactgaaaaccaaatatctatattatcactttcaacctcatgtttctgcaaagtacagaaaaactcctcactgacagtgcacccagcccctgactgggttttcaggattatgtccatgtgcataactgcttggatttcttcttttaaagtccctaaaacatgaatctgttctttgagatcctggtttccttagcagagttgtaggttgcgggtttcattcacgtggaaattctaagtagaacttttgctgccccattttactgttggtgaagggccgttgttaatggaagtttacgttttaaaactcagatgactcagaaaccagactgtgatcattttttgcagcagcaaaatgacttattctgacagcatctcggtttggggcttctgaagaaaaaggatgaagctgatctgttgaaacaactactttcccaactcggaggcaaaaggggctgatagaagataacattcacctaccatttcatcttgtgacccccagagatcacgtttgcgtgttctggctgagttttttattattgtttgttttaaatgattaaataatacacaattaaatgtcaggatagcatctcttgcaaagtgaccagtgcagcagaattgtctttctatccatatttgagcttagagaaacatttcccatgtcctaagttcttagaagcaattactttagcgttggggagcattgttctaccagacccatttatgcaggggagatgaagcttaaaagacgggatgtggggtgggagtgtgtttcttaagccgaagctgttgcaggctgggggatttttgcattttctttttgttttgtttttgactgcagattctgtacatctgtctgtgggaggagagttgctactcaggacaggatttaagagacacattccagtgacctttaagaatctgcatggcgggaggtccttctccaggagtgtgggttggtccactctgggacccaccacactaagaagggggagatgataaaataacattaaaggaagaatggcctccagcctgcaggttttgttggaaagaaataaaaagggagtcattaagaccataaattcagattgaggcctcttgaaaaggttgatgtgggctagcaacctgcctgtcgaaacagtccttggttcatcagcagtgtgggaaggcagccaaggctcctgcagattcctggcatcgaccttggaaagcctctgcgatacttgtgtgtacgaatacagcagaggacagggaggtccttgttctgtggtctctgtttagtgactgaaacttaaacccaaaggcaagcccagattgtctggccgttcatccccatgctttgataggggttaggaggaaccctttccgtatgaaagacaggccctactagggcttacaaccaagccaaaggaccatctcttctttcttccacctcccttcacccctgccccgcagcagagccgagatgtgagacattcattgtcacggagcaaggagacaaaggcaagttcaagttgagaagcatatggcagcaaacagaaatgaaaaccatatgtcccagcaaggggaaaagcagtcatttccagattataaaaatcaatgaagtactctccacctaggtcagctgaaattcgagccctcacagtcaggcctgtcagagaagttaagcagaaacatctcggggggacttctaaaatttagtgaagacaaggccttgcaactccaaagaaactttttttcccccccttgaaacagggtcttgctctgttgcccagcctggagtgcagtggtgcagtcacggctcactgcagcctcaagctcctgggctcaagcactatccccacctcaacctccttagtagctgggactacaggtgcacaccaccatgcccagctaaccacagaaactttcatctcttcattttttctttgggcaccattaatacctaagacaggtagaaagggtcccagaaagacaccattggtaatggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggctggcctgctcagtaacatacatgttccaaataaagattttgcatgaaagta

SEQ ID NO: 24193 - DNA, 6802 bp, Homo sapiens
gctgccgcgggcggtgggcggggatcccccgggggtgcaaccttgctccacctgtgctgccctcggcgggcctggctggccccgcgcagagcggcggcggcgctcgctgtcactgccggaggtgagagcgcagcagtagcttcagcctgtcttgggcttggtccagattcgctcctctggggctacgtcccggggaagaggaagcgaggattttgctggggtggggctgtacctcttaacagcaggtgcgcgcgcgagggtgtgaacgtgtgtgtgtgtgtgtgtgtgtgtgtgtgtgtgtgtgtgtgtgtgtgtaagacctgcgatgacgacgaggaggaacaagtgggacggcgagtgatgctcagggccagcagcaacgcatggggcgagcttcagtgtcgccagcagtgaccacagttcttgaggccaaatctggctcctaaaaaacatcaaaggaagcttgcaccaaactctcttcagggccgcctcagaagcctgccatcacccactgtgtggtgcacaatggcgccccccacaggtgtgctctcttcattgctgctgctggtgacaattgcaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagctgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccgcagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaatgtaaagtcatcgggcgtaatgaggaagaagggagtgaacatttaccgctttatgtacataacatatgcagtttacatactcatttgatccttataatcaaccttgaagaggagatactatcattcttatgttgcagatagccctctgaaggcccagagaggttaaataacttcccagaggtcatggccaagaagtagtggctccaagaactgaatgcaaattttttaaactgtagagttctgctttccactaaacaaagaactcctgccttgatggatggagggcaaattctggtggaacttttgggccacctgaaagttctattcccaggactaagaggaatttcttttaatggatccagagagccaaggtcagagggagagatggcctgcatagtctcctgtggatcacacccgggccacccctccctctaggtttacagtggacttcttctgcccctcctccttttctgtccttggccatctcagcctggcctctctgatccttccatcacagaaggatcttgaatctctgggaaatcaaacatcacagtagtgatcagaaagtgagtcctgtcttgtcaccccatttctcatcagaacaaagcacgagatggaatgaccaaccagcattcttcatggtggactgcttatcattgaggatctttgggagataaagcacgctaagagctctggacagagaaaaacaggccctagaatatgggagtgggtgtttgtagggctcacaggctaacaagcactttagttgctggtttacattcaatgaaggaggattcatacccatggcattacaaggctaagcatgtgtatgactaaggaactatctgaaaaacatgcagcaaggtaagaaaatgtaccactcaacaagccagtgatgccaccttttgtgcgcggggaggagagtgactaccattgttttttgtgtgacaaagctatcatggactattttaatcttggttttattgcttaaaatatattatttttccctatgtgttgacaaggtatttctaatatcacactattaaatatatgcactaatctaaataaaggtgtctgtattttctgtaatgcttatttttagggggaaatttgttttctttatgcttcagggtagagggatttcccttgagtataggtcagcaaactgtggcctacagcctgtgtgtgcacgccccatgagccgaaaagtgggtcttatgttttcaaatggttaaaaataaataaaaaaatttgaaacatgtgaactatatgacattcagatttgtgttcataaataaagttttattggaacata

SEQ ID NO: 24194 - DNA, 3239 bp, Homo sapiens
gctggggctcggggctcggctctgggagagctcgggcgggagcccagagagagccgcacggggacctcaagccagaccccagcgttcagccgccacctcggcccgggcccgccccgccccggccccgcccctttcctgcccgccccaccccctctacgcccctccacccggaccccgccccctgggcagccccccgccctctccgcccgggctccgccccctccccctggccctcgccaccggtccagggaggggacggcgggacaggcgggaccagtgggaccggcgggagggctgacagggcggggacatggccgcggcgccgggagggtcagcgcagcccgctggccccggcccgcgcctgggtttcagcaccgcggacagcggcgtcggcatgagcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaagggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaatgagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcctatgcaagagtgtctcacatgtgcttaaccgaggtgcttctagttggtgagcagtgttgagcttagaagtggtgtgtgctctgtctgtctgtctttgtctgtctgttgtatacagtgggtgccatataaagctgatcaatggtggtgcttcctgcctgcttctgtgagatgggcaaaagattcagcttagaacaccatgactcaccttgccttggtcagcctttcctgggcctgtagggccttgcacatatttttcccaggaggatttcccctccaccccacaggcatggatcagcttggtctgaggccccagctgtgtggggtccctctaatccccagatgttgctgaggctgaaggcctctgatctgataacatgtcagatagtaaaagatgtgggggtgggggtggagggctcctccttcataacagtttctaagaaaacttgttcccacctgtt

SEQ ID NO: 24195 - DNA, 911 bp, Homo sapiens
ggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttg

SEQ ID NO: 24196 - DNA, 15574 bp, Homo sapiens
gaaatcttttaggcctttagatgttgttctggaaaaactttagtaatggatcaaaggaagaatgagagtattgttcctagtataactcaattagaagattttcttacagaacacaattccaatgttgtttggctccttgttgctaccattttgtcctgtggatggattatttacctcacatattataattcccggaatgttggtcttattttaacactagttcttaacagattatacaagcatggctatatccatattggttccttctctttctctgttctttctggaaaagtcatggttcgtgaaatctattacattacagaagacatgtctattaggattcaagatggattcatcatttttcggtggtggaaaatgtataacccaaaacagaagcaacatgatccaaaggcagaaaccaggttatacatcacagtcaatgactttgaatttcatgtctataatcgctcggatctttatggacgccttcaagagttgtttggtttggagccaacaataattccacctaagaaagatgatgataaaacacgggaaattggaagaacaagaacccaatcgaaaattgaaagagttaaagtaaaaacagaatcccaagaccccacatcttcatggagatcacttattccagtcataaaggtcaatgtgagcacaggacgtttggcctttggaaatcactaccagccgcaaactctgtgcatcaactttgatgatgctttcttaacttatactacaaaaccaccttcaagtcatcttgaccaattcatgcatattgtgaaaggaaagcttgaaaatgttcgagtcatgcttgttcctagtccaagatatgttggtcttcaaaatgatgaaccaccgagattaatgggagaaggttttgtggtgatgcagtcaaatgatgttgacatctactactacatggatgagccaggacttgttccggaagaaacagaagaaaatattgaaggagaaatgagcagtgaggattgcaaattacaagacttgcctccatgttggggactggatatagtttgtggtaaaggaacagattttaattatggaccatgggccgataggcagagagattgtttgtggaagtttttctttccacctgactatcaagttctgaaagtttctgaaattgcacagcctgggagaccaagacagatccttgcttttgaattacgaatgaatattattgcagatgctacaattgatttgctgtttaccaaaaatagggaaacaaatgctgtacatgtaaatgtaggagctggctcatatttagaaattaatattccaatgacagttgaagaaaatggttacactcctgctattaagggacaactcttacatgtggatgccactaccagcatgcaatatcggacccttttagaagcagaaatgttagcattccacatcaatgccagctacccccgaatatggaacatgccgcagacatggcagtgtgaattagaggtttataaagccacttaccacttcatctttgcacagaaaaacttctttacagatttaattcaagactggtctagtgacagtcctccagacattttttcatttgttccatatacgtggaattttaaaatcatgtttcatcagtttgaaatgatttgggctgctaatcaacacaattggatcgactgttctactaaacaacaggaaaatgtgtatctggcagcctgtggagaaacactaaacattgatttttctttgccttttacggactttgttccagctacatgtaataccaagttctctttaagaggagaagatgttgatcttcatttgtttctaccagactgccaccctagtaaatattctttatttatgctggtaaaaaattgccatccaaataagatgattcatgatactggtattcctgctgagtgtcaaagtggccagaaaacagttaaaccaaaatggcgcaacgttactcaggaaaagtctggttgggttgaatgctggactgtcccaagtgtcatgcttacaattgattatacatggcatccaatttatccacaaaaagcagatgaacagctgaaacaatcattatcagaaatggaagagacaatgctatctgtattaaggccatcccagaagacatcagacagagttgtttcttctccctctacttcttcacgcccacctattgatccctcagaacttccacctgataaacttcatgtagaaatggaactttctccagattctcagataactctctatggacctctactaaatgcctttttgtgtataaaggaaaactactttggggaagatgacatgtatatggattttgaagaggttatctcaagtcctgttttgtcactgtcaacatcatccagctctgggtggactgctgttggaatggaaaatgacaaaaaggaaaatgaaggttcagccaagtcaattcatccacttgccttgcgtccttgggatattactgtacttgttaatttgtacaaagttcatgggcgtcttcctgttcatggaactactgatggtcctgaatgccctacagctttcttggaaagactatgttttgaaatgaaaaaaggatttagggagaccatgctgcaacttatcctgtcacccctgaatgtgtttgtcagtgataactatcagcagcgaccccctgtggatgaagtactcagggaaggtcacatcaatttgtcaggtctccagctgagagcacacgctatgttctcagcagaaggtcttcctttgggaagcgattccttagaatacgcatggttaattgatgtgcaggctggaagtcttacagctaaggtcacagcaccacagctggcatgcctcttggagtggggacagacatttgtttttcatgtggtatgtcgggagtatgaactggaaagaccgaaatcagttataatatgtcagcatggaattgatcgtcggttctgtgaatccaagttgagttgtattcctgggccttgtccaacttcagatgatttgaaatatactatgattcgtttagcagtagatggagccgatatttacattgttgagcatggttgtgctacaaatataaagatgggtgcaattcgagttgcaaactgtaatctccacaatcaatcggttggggaaggaatcagtgctgcaattcaggattttcaagtgagacagtacattgagcaattaaataattgcagaattggacttcagcctgcagtgctacggagggcctattggcttgaagctgggtcagccaatttaggacttattactgttgatattgctttagctgctgaccatcattctaaacatgaggcacaaagacatttcttagaaactcatgatgccagaactaagaggttgtggtttttatggccagatgatatcctgaagaataagaggtgtagaaacaaatgtggttgtctcggtggctgcagattctttggtggcacagtaactggcctagatttcttcaaacttgaagagttgacaccttccagtagctctgcattttcaagcacaagtgcagagtctgatatgtattatggacagtctctgctacagcctggagaatggataattactaaagaaattcccaaaattatagatggtaatgtgaatggcatgaagaggaaagaatgggaaaacaaatcagtgggaatagaagtagagagaaaaactcagcaccttagtcttcaagtaccattacgatctcatagttcatcctcttcctcagaagagaacagtagttctagtgctgcacagcctttgttggctggtgaaaaggaaagtccttcatctgttgctgatgaccatttggttcaaaaagagttcttgcatgggacaaaaagagatgatggccaagcaagtatccctacagaaatttcaggaaacagccctgtgtctcctaatactcaggataagtcagtaggtcaatctcctcttagatctcccttgaaacgacaagcctctgtctgttccacccgtcttggaagtactaagagtcttactgctgctttctatggggacaagcagcctgtaacagttggagtccagtttagtagtgatgtctctcgaagtgatgagaatgtactagactcaccaaagcagaggagaagttttggttcattcccatatacaccatcagcagactctaattcatttcatcagtatcgatcaatggattccagcatgtcaatggctgatagtgaagcctacttttctgctgctgaggaatttgagcccattagcagtgatgaaggccctggaacttatccgggtagaaaaaagaagaaaaagcaaacccagcagattgactacagtaggggttccatatatcacagtgtagaagggccacttactggacatggagaaagcattcaggattccagaactctgccattcaaaactcatccttctcaggcttcatttgtttctgcgttaggtggagaagatgatgttatagaacatctatatattgtagaaggtgagaaaacagtggagagtgaacagattactccgcaacaacccgtgatgaattgttatcagacttaccttactcagttccaggtaattaattggtcagttaagcacccaaccaacaaaagaacctctaaatcctcattgcatcgtccccttgatctggatacaccaaccagtgaagaaagttcatcgtcatttgaacagctttctgttccaacttttaaggttatcaagcaggggctcacagctaattctttgctagacagaggcatgcaactttcaggatcaacttcaaatacgccgtatactccattggaaaaaaaactcgctgataacacagatgatgaaacattaacagaagagtggaccctggatcaaccagtgtcccagaccaggacaacagccatagttgaagtaaaaggaactgttgatattgttttgactcccctggtggctgaagctttagacagatatattgaagcaatggttcattgtgctagtacccgacatccagctgcaattgtagatgatcttcatgctaaagtcctcagggaagctgtccaaaatagcaagactaccttttcagaaaatttatcttccaaacaagacattagaggaacaaaaactgagcagtctacaataggaacgactaaccaaggacaagcacagacaaatcttacaatgaagcaagataatgtaacaattaaaggtcttcagactaatgttagcataccaaaggtaaacttatgtttgttacaagcctcagtggaagaatctccaactacggctcctagtaggagtgtgactcatgtttccctagtggcattgtgttttgacagaattgctacacaggttcgcatgaacagaggtgtggttgaagagacttcaaacaatgcagaacctggtagaacatcaaattttgataggtatgttcatgccacaaagatgcagcctcagtcatctggatctctcagatcaaatgctggagcagaaaaaggcaaagaaattgcagctaagttaaacattcatcgagttcatgggcaacttaggggtcttgatacaacagacattgggacctgtgcaatcactgctattccttttgagaagtccaaagttttatttactcttgaagagttggatgaatttacttttgtggatgaaactgatcagcaagctgttccagatgtaactcgaataggtcccagccaagaaaaatggggatggataatgtttgaatgtggacttgaaaatttaaccataaaaggaggaagacagtctggtgctgttttatataacagttttggaattatgggtaaagctagtgacacagaaaggggtggagtgctgacatccaataattcttctgattctccaaccggcagtggctataatactgatgtctctgatgataatcttccatgtgaccggacaagcccttcctcagacttaaatggaaattctgtttcagatgaacaggatgaaggagtcgaatctgatgatttgaaaaaagatctacctctgatgcctcctcctccagattcatgtagcatgaagttgaccattaaagaaatttggtttagttttgcagctcccaccaatgtgagatctcacacacatgcattttctaggcagctgaaccttttaagcactgcaacaccagctgttggtgcatggcttgttcccattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacatttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatggtatgaaagatagtgcaacatctcctccttctcctcctttaccttccactgtccagagcaagactaacaccttacttcctccccagcccccacctattcctgcagccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaagtctgt

SEQ ID NO: 24197 - DNA, 3980 bp, Homo sapiens
cctcagtcctcccttggtggcctcgccgcggctctgctgggagacccggcgctggcggctgctgaggccggagcggagggcccgggagcgtgggagcaggagggtggcgcgcagccggtttcgcgtttggtcggccagggagctgccttcccaccagccggtcgaggaaacaacgggtcgggcttccggggagagggcccacacagtctcctcgccggcaccggcctcctccatttttccgggccttgcgtggagggttttggcggatgtttttgaacgaaggaatgtcatcggggctctctcgagcccctcaccccgccagctactctgggggtggcgtggcatagtgagaggagcgctaagttgttgggaggcctgggtccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggttttttttttttttttttggcttgttttttaaataaaccaaagtcaaaaacaaa

SEQ ID NO: 24198 - DNA, 3242 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaacaaatggcattcgttggcttcaaaggcagcttccggcccatctgggtga

SEQ ID NO: 24199 - DNA, 7357 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagagaaaagcttcattctggaggggaaggagttttgagtgccaaggatgaaattccacccatcactcggtctctgagctgcaggacacaggcaggacaacggtaggattttcatgccccgatctgcctggccttgagttgtggcagctggggaagccactgggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatc

SEQ ID NO: 24200 - DNA, 2321 bp, Homo sapiens
gcctcaagaggaggcataacagcagcggaccaatagaaattccgaatttttgtattctctgggaagctccacctcttagtccctgatccgccgcggaagatgaaaaaaagcggcccgggggcggagcaaggcaaggaagcggaagcggagaggcggtcgggatccgctgcgcgagctgtctcggtcccacgtgtgcgagttgctacgatggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcgggcaaagcagatgtgggagattttaagaagaaaagactgtgacaaagaaaaaagagtaaagttaatgagtgatttgcagaagttgattcaagggaaaattaaaactattgcatttgcacacgattcaactcgtgtgatccagtgttacattcagtatggtaatgaagaacagagaaaacaggcttttgaagaattgcgagatgatttggttgagttaagtaaagccaaatattcgagaaatattgttaagaaatttctcatgtatggaagtaaaccacagattgcagagataatcagaagttttaaaggccacgtgaggaagatgctgcggcatgcggaagcatcagccatcgtggagtacgcatacaatgacaaagccattttggagcagaggaacatgctgacggaagagctctatgggaacacatttcagctttacaagtcagcagatcaccgaactctggacaaagtgttagaggtacagccagaaaaattagaacttattatggatgaaatgaaacagattctaactccaatggcccaaaaggaagctgtgattaagcactcattggtgcataaagtattcttggacttttttacctatgcaccccccaaactcagatcagaaatgattgaagccatccgcgaagcggtggtctacctggcacacacacacgatggcgccagagtggccatgcactgcctgtggcatggcacgcccaaggacaggaaagtgattgtgaaaacaatgaagacttatgttgaaaaggtggctaatggccaatactcccatttggttttactggcggcatttgattgtattgatgatactaagcttgtgaagcagataatcatatcagaaattatcagttcattgcctagcatagtaaatgacaaatatggaaggaaggtcctattgtacttactaagccccagagatcctgcacatacagtacgagaaatcattgaagttctgcaaaaaggagatggaaatgcacacagtaagaaagatacagaggtccgcagacgggagctcctagaatccatttctccagctttgttaagctacctgcaagaacacgcccaagaagtggtgctagataagtctgcgtgtgtgttggtgtctgacattctgggatctgccactggagacgttcagcctaccatgaatgccatcgccagcttggcagcaacaggactgcatcctggtggcaaggacggagagcttcacattgcagaacatcctgcaggacatctagttctgaagtggttaatagagcaagataaaaagatgaaagaaaatgggagagaaggttgttttgcaaaaacacttgtagagcatgttggtatgaagaacctgaagtcctgggctagtgtaaatcgaggtgccattattctttctagcctcctccagagttgtgacctggaagttgcaaacaaagtcaaagctgcactgaaaagcttgattcctacattggaaaaaaccaaaagcaccagcaaaggaatagaaattctacttgaaaaactgagcacataggtggaaagagttaagagcaagatggaatgattttttctgttctctgttctgtttcccaatgcagaaaagaaggggtagggtccaccatactggtaattggggtactctgtatatgtgtttcttctttgtatacgaatctatttatataaattgtttttttaaatggt

SEQ ID NO: 24201 - DNA, 563 bp, Homo sapiens
acacagtgagggaggcaaaacagtgtggatgcagcagaataaccacaaccaggattttgaactgaataagtaagaaagattatcactttgaatatacggaatgtgatagcagtggctccaggtggagagttgccattccaaattctgcagtggactgctctggcctgcctgacccagtgagaggcaaagaatgcactttctcctgtgcttctggagagtatctagaaatgaagaaccaggtatgcagtaagtgtggtgaaggcacctattccttgggcagtggcatcaaatttgatgaatgggatgaattgccggcaggattttctaacatcgcaacattcatggacactgtggtgggcccttctgacagcaggccagacggctgtaacaactcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggag

SEQ ID NO: 24202 - DNA, 1925 bp, Homo sapiens
cggaagttgaccggggtgcggagctcctgggctgcagctcctggagtttccgaggttcgtgcgcgtctggtggcggcggcgtgatgttctcggcaggagcggagagtttgctccaccaggccagggagatccaggacgaggagctgaagaagttctgttcccggatctgtaaactgctgcaggcggaggacttggggccggacaccctcgactccctgcagaggctcttcctcatcatctcagccacgaagtacagccggaggctggagaagacatgcgtagacctgctgcaggccaccctcggcctgcctgcatgccccgagcagctccaggtgctttgcgccgccatcctgcgagagatgtccccctctgacagcctcagcctggcctgggaccacacgcagaacagccggcagctgagcctggtggcctccgttctcttggcccagggtgacagaaacgaggaggtcagagccgtgggccagggcgtgctacgagcgctggagagccggcagcctgagggacccagcctcagacacctcctccccgtcatggccaaggtcgtggtcctcagcccgggcaccctccaggaggaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtgctctccagcggccaccgcttcacagacgaccagtggctgaacgtgcaggccttctctatgctgcgggcgtggctgctgcacagcggccccgagggcccgggcaccctggacacagatgacaggtcagagcaggagggctccactctgtcggtgatctccgccacctcctctgccggccgcctgctgccgccccgggagcggcttcgggaggtggccttcgagtactgccagcgcctcattgagcaaagtaaccgacgagccctgaggaagggggactccgacctgcagaaagcttgcctggtggaggccgtgctggtgctggacgtgctgtgccggcaggacccgtccttcctgtaccgaagtctctcctgcctgaaggccctgcacgggcgggtgcgcggggacccggcctctgtgcgggtgctgctgcccctcgcccacttcttcctgagccacggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaagttcctggcctggaacagcccacccctcacctccgagtttgtggcgctcctcccggccctggtggacgctggcacagccctggagatgctgcacgcgctgctggacctgccctgcttgacggcggtgctggacctgcagctcaggtcagcaccggctgcatccgagaggccactctgggacacctctctcagggcccccagctgcctggaggccttccgggacccgcagttccagggtcttttccaatacctgctgcgccccaaggccagtggcgccactgagaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacaggcctgatgcatgcaggcccatcctggttccactctga

SEQ ID NO: 24203 - DNA, 2028 bp, Homo sapiens
ccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaa

SEQ ID NO: 24204 - DNA, 3179 bp, Homo sapiens
tcattgacacagtgagggaggcaaaacagtgtggatgcagcagaataaccacaaccaggattttgaactgaataagtaagaaagattatcactttgaatatacggaatgtgatagcagtggctccaggtggagagttgccattccaaattctgcagtggactgctctggcctgcctgacccagtgagaggcaaagaatgcactcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggagatggacaccaccactgacaagtgggtaaaacttacagacaatggagaatggggctctcattctgtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcatta

SEQ ID NO: 24205 - DNA, 6283 bp, Homo sapiens
gacccgagagccgctgagccgcgaggccgggccggggcgccggccgggaatgccgggggcgcggcgccgacgccgaggcgcggccatggaggggaagccccgcgccggggtcgcgctggccccggggccgagcggccgacggccttccgcccgctgcgcccgccgccgccgcccggggctgctgcttcctggcctctggctgctgctgctggcccggccggcctcgtgcgccccagatgagctctctccggaacagcacaacctttctttatactccatggagctcgtgctgaagaaaagcactgggcacagcgctgcacaagtggccttaacagaaactgctcccggctcccagcacagcagtcctctccatgtcacagccccgccgtctgccactacttttgatacagccttttttaaccaaggaaaacagaccaaaagtacagcagatcccagcatctttgtggcaacttacgtgtcagtgacgagtaaagaggtggccgtcaatgacgatgagatggataactttctgccagatactcactggaccactccacggatggtttctccaatacagtatatcacagtcagcccaccagggctgcccagggaagcattagaacctatgctcactccatcattacccatggtttctttacaagatgaagaagtgacatcgggctggcagaacacaacgcgacaaccagcggcatatgctgagtccgccagtcatttccacacctttcggtcagcttttcgcacctctgagggcatcgttccaactcctggcaggaatttggtgctttatcctactgatgcttacagtcatttatcaagcaggactctgccagagattgtggcttccctaacagagggtgtggaaaccaccctttttttaagctcccggtctttaatgccacagccgttaggcgacggcattactataccgttgccctccttgggggaggtctcacagcctccagaggaggtttgggccacaagtgcagacagatacactgatgtgaccactgtgttgagtcaaagcctagaagaaaccatctctccaagaacataccccactgtgactgcatcgcacgcagcccttgcattcagcaggacacattctccattgctttcaactcctcttgcatttgcgtcctctgcttcaccaactgatgtttcatctaacccctttctccctagcgactccagcaaaacatccgaattgcatagcaattcagccctccccggtcctgtggacaacactcatatcctgagcccggtgtcctcattcagaccatacacttggtgtgcggcctgcactgtgccttcacctcagcaagttctggccacgagcctcatggagaaagacgtgggatcaggggatggtgccgagactctgtgcatgaccgtgctggaagaaagcagcatctctctaatgagtagcgtcgtagcagacttctctgaatttgaggaagatcctcaagtatttaatacgcttttcccctccagacctatcgtcccactttcttctagatccatggaaatctcagagacgagtgttggcatttctgccgaggtggatatgagtagtgttacaaccacacaggttccccctgcccacggccgcctctctgtgccggcgtcacttgatcctactgctggctccttgtctgttgctgaaacccaagtgacgccatccagcgtgaccactgcatttttctcggtcatcaccagcattctccttgactcatctttctctgtcatagcaaacaaaaacacaccgtcgcttgccgtcagagacccgagtgtttttacgccttatagtctggttccttcagtggagtcttcacttttctctgaccaagaacgttccagtttttctgagcataaacccagaggtgctttggattttgcatccagctttttctcaacacccccgctggaactcagcggctccatctcttcgccttcggaagcacctgcgtctctgtctctgatgccgagtgacttgtcccccttcacatctcagtctttttctcccttggttgagacatttacattgtttgactctagtgatctgcagtcatctcagctgtctcttcccagttccacaaatcttgagttttcgcagctccagccaagttccgagctgcctttaaacaccatcatgttgctacctagccgttctgaggtgtcaccatggtcaagcttcccttctgattctctcgagtttgttgaagcgtctacggtttcactgacggattcagaagctcattttacctcagctttcattgaaactacctcctatcttgagtcttcactcatttcccatgaatccgcagtcactgcactggtgccccccggctctgagtcttttgacattttgactgccgggattcaagcaacatcaccattgaccactgtccacacaacgcccattttaactgagtcttctttgttctcaactctgacacctcctgacgaccaaatcagtgctctagacggtcacgtgtctgtcctggcctctttctccaaagccattcccactggtacggtgttgatcactgacgcgtacctgccatcaggatcctcgtttgtttctgaagcaacccccttccctctgcccacagagctgaccgtcgtgggcccatcactcacacccacagaggtgccactgaacacctccacggaagtgagcacaaccagcaccggtgctgccactggtggtcccctcgactccaccctgatgggtgacgccgcaagtcagagccccccagagagtagtgctgctcctcccctgccatccctgcgtcccgtgactgccttcactctcgaagcaacagtcgacacaccaacactggctactgccaagccgccatatgtttgtgatatcacagtccccgatgcctatctgatcacaactgtgctggccagaagagctgtgcaggagtacatcattacagcaatcaaagaagtactgaggattcacttcaaccgtgcagtggaactgaaggtttacgaactatttactgacttcacttttctggtaacatccggtcctttcgtttacacggcaatatccgtcataaatgtgcttataaacagtaagcttgtccgtgaccagactcctttaatcctgtctgtgaaaccttctttccttgtgccagagtccaggttccaagttcaaacagtacttcagtttgtgcctccgagtgtggatactggcttctgcaacttcacccagcgcattgagaaaggcctaatgacagctctctttgaagtgagaaaacaccaccagggaacgtataacctcacggtgcagatcttgaatatcaccatcagttcctcaagggtgactcctcggcggggcccggtgaatatcatctttgcggttaaaagcacacagggatttttgaatgggtcggaagtgagcgagctgctcagaaacttgagtgtggtggagttcagtttctatctgggatacccagtgctgcagatcgcagagcccttccagtatccacagctcaacttatctcagttgctgaagtcctcttgggtcagaacagttctcctgggcgtcatggagaagcaactccagaatgaagtgtttcaagccgagatggaacgcaagctggcccagctgctcagcgaggtttccaccagaaggcggatgtggagaagggccactgtagctgcagggaacagtgtggtgcaggtggtaaatgtgtcgaggctggagggagatgacaatccggtacagctcatctactttgtggaggatcaagatggagaaagactcagtgcagtcaagtcttcggacctgattaacaaaatggacctccagagagcagccatcatcttgggttaccgaattcaaggtgtcattgcccagcctgtcgacagggtgaagaggccgtctccggaatcccagagcaacaacttgtgggtcattgttggcgtggtcatcccagtgctggtggtgatggtgattgttgtcatcctctactggaaactatgccgcacagacaagctagactttcagcctgacactgtggccaacattcagcagcgtcagaagctgcagatccctagtgtgaagggcttcgattttgctaagcagcatctgggtcagcacaataaagacgacatattgattattcatgagccagcgccactgccaggacctctgaaggaccacaccacgccctcggaaaatggagacgtgccaagccccaagtcaaagatcccttccaagaatgttcgtcacagaggaagagtttctccctcagatgctgactctacggtcagtgaagagtccagcgagagggacgcaggagataagacgccgggagccgtcaacgatggcaggtcccacagagctccgcagagcgggccaccactgcccagttcgggaaatgagcagcactcatcagcctccatcttcgagcacgtggacaggatctcccgccccccggaggctagccggcgggtccccagtaagatccagcttatcgccatgcagccgatcccggcacctcccgtccagcgcccctccccagccgaccgagtggcggaaagcaataaaatcaacaaagagattcagaccgcgctgcggcacaagtctgagatcgagcaccatcgcaacaagatccgcctgcgcgccaagcgccgcgggcactacgagttcccggtggtagacgacctgtcctcgggcgacactaaggagcgacaccgggtgtaccgcagggcacagatgcagatcgacaagatcctggaccccacggccagcgtgccctccgtgttcatagagcccaggaagagctcacggataaaacgttctcccaagcctcgccggaaacaccaggtcaacggctgtcctgccgacgctgagaaggaccggctcatcaccacagacagcgatggcacctacaggaggccccccggcgtccacaactcagcctacatcggatgcccatcggatcctgacctcccagccgatgtgcagacaccatcctcggtggaactggggaggtatccagcccttcccttcccggcctcccagtacatcccaccccagccgtccatcgaggaggcacgccagaccatgcactccctcctggacgacgcctttgccctcgtggcccccagcagccagcctgccagcaccgcaggtgtaggccccggagtcccacccggcctgcccgcaaacagcaccccttcccaggaagagaggcgagccacccagtgggggtccttctacagcccagcccagacggccaacaatccctgcagtagatacgaagactatggaatgactcccccgacgggtccattgccaagaccaggttttggccccggtttgctgcagtctacagagctggtgccccctgaccctcagcagccacaggcctccgccgaagccccatttgctgccagagggatctactcggaggagatgccgtcggtggcccggcctcggcctgtcgggggtaccacaggctcccagatccagcacctgacacaggtggggattgccagcagaattggagctcagccagtggaaatcccgccaagcagaggcagccagtatggggggccaggctggccttcgtacggggaggacgaagcggggcgaagagaggccacacacatgctcggacatcaagagtattcttcttcaccgctatttcaggtgccaaggacttcaggcagggagccctcagctccttccgggaacctcccccaccggggactgcagggccctgggctgggttaccccaccagctccacggaagacctccagcctggccactcctcggcctctctcatcaaagcaatccgcgaggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtattttggccaaaagccagcagcacttcacaaaaacaaaacacaaacctaagctaacaaaatgactgcattcgtctcttttttaaaggtagagattaaactgtatagacagcatagggatgaaaggaaccaagcgtttctgtgggattgagactg

SEQ ID NO: 24206 - DNA, 508 bp, Homo sapiens
caaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgagggattccgactacaatctcctaaaagcagaaacaaccttttgggttttacctgtgtttgaagaagagactcgcattttccagaaagacatttgatgtttgtgttttatttctttcaaaatatgccttgtgctgaattttggcttggaatcaccaactctgcctgtattgtgatccccaagactccagacctcagagtcacctgctggcttagaggagtggagtgctttctatgtaatgaaaaggtgg

SEQ ID NO: 24207 - DNA, 6620 bp, Homo sapiens
agtagcttcagcctgtcttgggcttggtccagattcgctcctctggggctacgtcccggggaagaggaagcgaggattttgctggggtggggctgtacctcttaacagcaggtgcgcgcgcgagggtgtgaacgtgtgtgtgtgtgtgtgtgtgtgtgtgtgtgtgtgtgtgtgtgtgtgtaagacctgcgatgacgacgaggaggaacaagtgggacggcgagtgatgctcagggccagcagcaacgcatggggcgagcttcagtgtcgccagcagtgaccacaggtacggtatctacttcccagagcgcctggccgagaaataggaaagagggcagccagtaggcaggccaatacccaacaaaagtagaatcgagacgccctgagttcagaaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagctgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccgcagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaatgtaaagtcatcgggcgtaatgaggaagaagggagtgaacatttaccgctttatgtacataacatatgcagtttacatactcatttgatccttataatcaaccttgaagaggagatactatcattcttatgttgcagatagccctctgaaggcccagagaggttaaataacttcccagaggtcatggccaagaagtagtggctccaagaactgaatgcaaattttttaaactgtagagttctgctttccactaaacaaagaactcctgccttgatggatggagggcaaattctggtggaacttttgggccacctgaaagttctattcccaggactaagaggaatttcttttaatggatccagagagccaaggtcagagggagagatggcctgcatagtctcctgtggatcacacccgggccacccctccctctaggtttacagtggacttcttctgcccctcctccttttctgtccttggccatctcagcctggcctctctgatccttccatcacagaaggatcttgaatctctgggaaatcaaacatcacagtagtgatcagaaagtgagtcctgtcttgtcaccccatttctcatcagaacaaagcacgagatggaatgaccaaccagcattcttcatggtggactgcttatcattgaggatctttgggagataaagcacgctaagagctctggacagagaaaaacaggccctagaatatgggagtgggtgtttgtagggctcacaggctaacaagcactttagttgctggtttacattcaatgaaggaggattcatacccatggcattacaaggctaagcatgtgtatgactaaggaactatctgaaaaacatgcagcaaggtaagaaaatgtaccactcaacaagccagtgatgccaccttttgtgcgcggggaggagagtgactaccattgttttttgtgtgacaaagctatcatggactattttaatcttggttttattgcttaaaatatattatttttccctatgtgttgacaaggtatttctaatatcacactattaaatatatgcactaatctaaataaaggtgtctgtattttctgtaatgcttatttttagggggaaatttgttttctttatgcttcagggtagagggatttcccttgagtataggtcagcaaactgtggcctacagcctgtgtgtgcacgccccatgagccgaaaagtgggtcttatgttttcaaatggttaaaaataaataaaaaaatttgaaacatgtgaactatatgacattcagatttgtgttcataaataaagttttattggaacatatcc

SEQ ID NO: 24208 - DNA, 3346 bp, Homo sapiens
ttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaaatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggttt

SEQ ID NO: 24209 - DNA, 12379 bp, Homo sapiens
gacccgagagccgctgagccgcgaggccgggccggggcgccggccgggaatgccgggggcgcggcgccgacgccgaggcgcggccatggaggggaagccccgcgccggggtcgcgctggccccggggccgagcggccgacggccttccgcccgctgcgcccgccgccgccgcccggggctgctgcttcctggcctctggctgctgctgctggcccggccggcctcgtgcgccccagatgagctctctccggaacagcacaacctttctttatactccatggagctcgtgctgaagaaaagcactgggcacagcgctgcacaagtggccttaacagaaactgctcccggctcccagcacagcagtcctctccatgtcacagccccgccgtctgccactacttttgatacagccttttttaaccaaggaaaacagaccaaaagtacagcagatcccagcatctttgtggcaacttacgtgtcagtgacgagtaaagaggtggccgtcaatgacgatgagatggataactttctgccagatactcactggaccactccacggatggtttctccaatacagtatatcacagtcagcccaccagggctgcccagggaagcattagaacctatgctcactccatcattacccatggtttctttacaagatgaagaagtgacatcgggctggcagaacacaacgcgacaaccagcggcatatgctgagtccgccagtcatttccacacctttcggtcagcttttcgcacctctgagggcatcgttccaactcctggcaggaatttggtgctttatcctactgatgcttacagtcatttatcaagcaggactctgccagagattgtggcttccctaacagagggtgtggaaaccaccctttttttaagctcccggtctttaatgccacagccgttaggcgacggcattactataccgttgccctccttgggggaggtctcacagcctccagaggaggtttgggccacaagtgcagacagatacactgatgtgaccactgtgttgagtcaaagcctagaagaaaccatctctccaagaacataccccactgtgactgcatcgcacgcagcccttgcattcagcaggacacattctccattgctttcaactcctcttgcatttgcgtcctctgcttcaccaactgatgtttcatctaacccctttctccctagcgactccagcaaaacatccgaattgcatagcaattcagccctccccggtcctgtggacaacactcatatcctgagcccggtgtcctcattcagaccatacacttggtgtgcggcctgcactgtgccttcacctcagcaagttctggccacgagcctcatggagaaagacgtgggatcaggggatggtgccgagactctgtgcatgaccgtgctggaagaaagcagcatctctctaatgagtagcgtcgtagcagacttctctgaatttgaggaagatcctcaagtatttaatacgcttttcccctccagacctatcgtcccactttcttctagatccatggaaatctcagagacgagtgttggcatttctgccgaggtggatatgagtagtgttacaaccacacaggttccccctgcccacggccgcctctctgtgccggcgtcacttgatcctactgctggctccttgtctgttgctgaaacccaagtgacgccatccagcgtgaccactgcatttttctcggtcatcaccagcattctccttgactcatctttctctgtcatagcaaacaaaaacacaccgtcgcttgccgtcagagacccgagtgtttttacgccttatagtctggttccttcagtggagtcttcacttttctctgaccaagaacgttccagtttttctgagcataaacccagaggtgctttggattttgcatccagctttttctcaacacccccgctggaactcagcggctccatctcttcgccttcggaagcacctgcgtctctgtctctgatgccgagtgacttgtcccccttcacatctcagtctttttctcccttggttgagacatttacattgtttgactctagtgatctgcagtcatctcagctgtctcttcccagttccacaaatcttgagttttcgcagctccagccaagttccgagctgcctttaaacaccatcatgttgctacctagccgttctgaggtgtcaccatggtcaagcttcccttctgattctctcgagtttgttgaagcgtctacggtttcactgacggattcagaagctcattttacctcagctttcattgaaactacctcctatcttgagtcttcactcatttcccatgaatccgcagtcactgcactggtgccccccggctctgagtcttttgacattttgactgccgggattcaagcaacatcaccattgaccactgtccacacaacgcccattttaactgagtcttctttgttctcaactctgacacctcctgacgaccaaatcagtgctctagacggtcacgtgtctgtcctggcctctttctccaaagccattcccactggtacggtgttgatcactgacgcgtacctgccatcaggatcctcgtttgtttctgaagcaacccccttccctctgcccacagagctgaccgtcgtgggcccatcactcacacccacagaggtgccactgaacacctccacggaagtgagcacaaccagcaccggtgctgccactggtggtcccctcgactccaccctgatgggtgacgccgcaagtcagagccccccagagagtagtgctgctcctcccctgccatccctgcgtcccgtgactgccttcactctcgaagcaacagtcgacacaccaacactggctactgccaagccgccatatgtttgtgatatcacagtccccgatgcctatctgatcacaactgtgctggccagaagagctgtgcaggagtacatcattacagcaatcaaagaagtactgaggattcacttcaaccgtgcagtggaactgaaggtttacgaactatttactgacttcacttttctggtaacatccggtcctttcgtttacacggcaatatccgtcataaatgtgcttataaacagtaagcttgtccgtgaccagactcctttaatcctgtctgtgaaaccttctttccttgtgccagagtccaggttccaagttcaaacagtacttcagtttgtgcctccgagtgtggatactggcttctgcaacttcacccagcgcattgagaaaggcctaatgacagctctctttgaagtgagaaaacaccaccagggaacgtataacctcacggtgcagatcttgaatatcaccatcagttcctcaagggtgactcctcggcggggcccggtgaatatcatctttgcggttaaaagcacacagggatttttgaatgggtcggaagtgagcgagctgctcagaaacttgagtgtggtggagttcagtttctatctgggatacccagtgctgcagatcgcagagcccttccagtatccacagctcaacttatctcagttgctgaagtcctcttgggtcagaacagttctcctgggcgtcatggagaagcaactccagaatgaagtgtttcaagccgagatggaacgcaagctggcccagctgctcagcgaggtttccaccagaaggcggatgtggagaagggccactgtagctgcagggaacagtgtggtgcaggtggtaaatgtgtcgaggctggagggagatgacaatccggtacagctcatctactttgtggaggatcaagatggagaaagactcagtgcagtcaagtcttcggacctgattaacaaaatggacctccagagagcagccatcatcttgggttaccgaattcaaggtgtcattgcccagcctgtcgacagggtgaagaggccgtctccggaatcccagagcaacaacttgtgggtcattgttggcgtggtcatcccagtgctggtggtgatggtgattgttgtcatcctctactggaaactatgccgcacagacaagctagactttcagcctgacactgtggccaacattcagcagcgtcagaagctgcagatccctagtgtgaagggcttcgattttgctaagcagcatctgggtcagcacaataaagacgacatattgattattcatgagccagcgccactgccaggacctctgaaggaccacaccacgccctcggaaaatggagacgtgccaagccccaagtcaaagatcccttccaagaatgttcgtcacagaggaagagtttctccctcagatgctgactctacggtcagtgaagagtccagcgagagggacgcaggagataagacgccgggagccgtcaacgatggcaggtcccacagagctccgcagagcgggccaccactgcccagttcgggaaatgagcagcactcatcagcctccatcttcgagcacgtggacaggatctcccgccccccggaggctagccggcgggtccccagtaagatccagcttatcgccatgcagccgatcccggcacctcccgtccagcgcccctccccagccgaccgagtggcggaaagcaataaaatcaacaaagagattcagaccgcgctgcggcacaagtctgagatcgagcaccatcgcaacaagatccgcctgcgcgccaagcgccgcgggcactacgagttcccggtggtagacgacctgtcctcgggcgacactaaggagcgacaccgggtgtaccgcagggcacagatgcagatcgacaagatcctggaccccacggccagcgtgccctccgtgttcatagagcccaggaagagctcacggataaaacgttctcccaagcctcgccggaaacaccaggtcaacggctgtcctgccgacgctgagaaggaccggctcatcaccacagacagcgatggcacctacaggaggccccccggcgtccacaactcagcctacatcggatgcccatcggatcctgacctcccagccgatgtgcagacaccatcctcggtggaactggggaggtatccagcccttcccttcccggcctcccagtacatcccaccccagccgtccatcgaggaggcacgccagaccatgcactccctcctggacgacgcctttgccctcgtggcccccagcagccagcctgccagcaccgcaggtgtaggccccggagtcccacccggcctgcccgcaaacagcaccccttcccaggaagagaggcgagccacccagtgggggtccttctacagcccagcccagacggccaacaatccctgcagtagatacgaagactatggaatgactcccccgacgggtccattgccaagaccaggttttggccccggtttgctgcagtctacagagctggtgccccctgaccctcagcagccacaggcctccgccgaagccccatttgctgccagagggatctactcggaggagatgccgtcggtggcccggcctcggcctgtcgggggtaccacaggctcccagatccagcacctgacacaggtggggattgccagcagaattggagctcagccagtggaaatcccgccaagcagaggcagccagtatggggggccaggctggccttcgtacggggaggacgaagcggggcgaagagaggccgtgccaaggacttcaggcagggagccctcagctccttccgggaacctcccccaccggggactgcagggccctgggctgggttaccccaccagctccacggaagacctccagcctggccactcctcggcctctctcatcaaagcaatccgcgaggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtattttggccaaaagccagcagcacttcacaaaaacaaaacacaaacctaagctaacaaaatgactgcattcgtctcttttttaaaggtagagattaaactgtatagacagcatagggatgaaaggaaccaagcgtttctgtgggattgagactggtacgtgtacgatgaacctgctgctttgttttctgagaagaggtttgaagacattttattaacagcttaatttttctcttttactccataggaacttattttaatagtaacattaacaacaagaatactaagactgtttgggaattttaaaaagctactagtgagaaaccaaatgataggttgtagagcctgatgactccaaacaaagccatcacccgcattcttcctccttcttctggtgctacagctccaagggcccttcaccttcatgtctgaaatggaactttggctttttcagtggaagaatatgttgaaggtttcattttgttctagaaaaaaaaaatccctcccaaagtggggcaaaaagctttatatttatttgattatccaaaatacagatcaaagtttagatctacattcttcattgtatttgctgtttcttaattgggcacacacaactcctggtcatgtcccagttcagcaccgatcgctaaggccgatcctgtagaatgcggctttcaagaggtcctaactgatcctttcttccactttgctgttgatttgttcacaaattatgtctgaatgagaaatcttctgtaagcagaagttatttaataattcccagcaccacgaaattgttatacatacatccctaccagtcacattccctgtgttcagagcctggaaatgaaattgagttcagttcagcctctctgtaatgaatcaagaaatgtaaaagagctttgagaccccaagggaaaggagagagttgcttctcatttctgattttattgtgctgttactctgtcgagtggctattaaaattgtcttatgctctttgggctaagaggggatcatctcgcttaagatgtactcctgatgtaaacatttcccccactttccaaataatggtaaagaaaacagtggcaagggctgttctgttttctggtacctgagtgaaactcagaagaaaagcaggcttagctaagagattttcactattaacctgtttttattagatcagcgaagacagtcatgcatcgcttaatgatggggatgcattctgagaaatgtgtcattaggctgttttgttgctgtgccaacatcctagattgtacttacacaacctacatggtatagcctactacacacctgggctgtgtggcatggcctattcctcttaggctacaaacctgtacagcatgttactgtactgaacacaatggtaagtatttgtgtatctaaacatagctaaacatagaaaaggtatggtaaaaatacaattttataatcttatgggactaccatcaatatgtagaccgtcattgaccaaaacatcctgatgtgtgcatgactgtacttttcattaaataacagataaggggctatagaatttggggctctgactgatcaaaacctgtgtatctgtgtcaagttttaagacccctgaaacagctaaaacaggtttccaaagtgtaatcactggatttcaaaaccatgttttagcccttcattaatgaagcctgttgtacagatttagagtcttacaatatgagggaagttggttctgggaaggtaagatgtagccagttttcatctgggcacctctgaaagagaaggagtgcaggagagtaagtctctcaaggacgttcaacaaaggaccagcagcatcttatcaggcgatcctcagaggctccaaggagcattggagagaatgcccctttctgggcttgatgtcttggttttggtttaataccaaatttctcttggtcttggtttaatacccgactcctcccaaattgaacgattatctttgtatgtcactcaaaaataccaggtttcctgaatatgttattaagaatttcagatatccaagcagaattttattatggacaccttgtaatgaattcaaatcgtgtgacagcaaacgggataaatggccccttctcacccagttccgctcagggccatacaggcttgcacatagagtgtgctaaaaatggtaacctcctttgagcattgcagaaagagggttctgtttcaaattgggctgaccgtaaaagcaattttgatgtctttcaaactaccataaagggattttaactgtatttttattcttagaaacaatacacctttaaacagatgtcaagaccaaagatgatgtataataaacagccggtggttatggtgtggtgtgagcaggcccccggatcaccagccctctgctggtggtcataaagcacacacagtttgtacttgcttcctctcgacgcctgccacaacagttttgccagtcaccaaactcagaaaaaactagctgtgtgagcagcaccgtaccctagcggtcttcagacattaagttcacgtcatccactgaaaggaagggtccttgcgttgacagcgtgtggctttggagtccgtttatggaagcactctacaatgaacagttgaattttatgtctattcttttttcctattttaaaagttctagtggtaacacaaactgtaaatttgagtcagaatgtttggagaaatgttgtttttttttttttcagagactactttgtcactcactgaccatgtctggttccttctctgaacttcattctccccataagccaaacaagaacagacctcccccgccacctcccaggcaccgtagttgtgagaatcagatgtgatcatgtgtgcagatgtcctgtgaggagggagcataaagcactgtgaaaatgtagcatgctgtctatgtggacgccctaggatgagtgatgtgaaacgctgcactactgcggtgaatgggttcacacatgggtaatgagcaaaaccgaaagctcggtgtgactcagtttcctcactcccattttgctttaatttcacttccttcaccaattttccgattgcatttattaagcatctttctgctcccgactttctggtgtctctggcaccaaataacccagcagacatgagccttgccttctgagattttagaatctaagatagcacgagtgggtatagaagatggaagataccgataaataacatggtttaagtgtcaataaaattcattcgaagagatcaggcgcggtggctcacgcctgtaatcccagcattttgggaggctgaggcaggtggatcacttgagatcaagagcttaaaaccagcccaggcaacatggcaaaaccccgtctctacaaaaaaatacaaaaactagctgggtgtggtggcgcatgcctgtagtcccagctgaggcacgataattgcttgaacccggggggtggaggttgcagtgagctgagattgcaccactgtactccaacctgggcgacagagcaagactgtgtctcaaaaagaaaaaaatttgttcaaaagacataaatgaattaggcacccagaagaagttgcatgtttggaaatgcaatatcttggggagacgtcaacttctgaagtgactttgaaggcagggcagctacccaggcaaatggcgtggaaggaagagctgagagtgggcctgggaaaggctgtagggaaggagtgaagctgtcactgaaatgaacttgatcttgatctgctttgatatggggacagaatccccgactgcactattgagggagtttcagaagagaaggaagaggtgctggaaggatgcttttgcagtcatgcagcaaggaaacgaccagggctgtgaagatctacagaggaagtactccagtgtgggggaggcaagggaagaggacgaaaatgatgagaatgacactgaggtcattgtttagagcagatctcaagcagccgtttggccacgccatatcctttgtggagcatagtgggttatctatctgtctgtctgtctatgtatctgtctatctatctatatatatattcagcttctttactgctacctacacatttttctccaaattttattaatttcatagtgttttgatttgggtggcagatgacttttaagcagtgggtgtttgccggccagatctttcctggcatgcggactgtgaggcaaagcacgggtgaaggtaggcgctaaaggctttgggctaaagccagcacgcggttctgtgctataggagtctcccgtttcccgtggacaggttcagcgttccttctttcgcacaacttttttctaagtgttccagtgaccaagccagtcattcggacactgatttgcagtgcattggcagtaattcacaaattagttgttatataagtctctctcatccctttcacactagattctcagacatgaatgaatttgtcgtttggaaggaaagctgggtaacgttttgggcacaggggaaggaggactccggtcttaactcccacgctaactttagctcaagtggagttttcaccgtggtcatttctacctccggagcaaggtgccagcgccagtactagagcctgcttatccacatttgccctggacaggagcaggaggaagtccacttctgtaccggcagacagagcatgtgaacacaaaacacatttctatggcatagtcaactgaacttcatttttacatttaatctaacatgttaacacgttctaacagggtttctatgagcagctgctgtaacatactcatcaactatgatagacttaacacttgttacctaatgaacaaggaggatgtgcatttcgggtttcttttgatattcgtggaggtgattgtcagtgtttaaacaggactactttctccactatgaagatgacttggaaatcgcaacatcatggtacattgctaagtccatgcttgtgtgtgtgacagtaggcttgataatttatcttaaaacacagcagcattgaaatttaggaaaagaatattaaatgcctttggaaacatgaaacaaagttaggagccagtaagaaagtgacagaagcaatgaatgtcttaatgcagtatagttaaaatggcttcccacagggtagataattatccaggatccttccttttccttcttcctccaggtttttcaggggtcacttcacatttctaaagaaagagtgaataggctgggcatggtggctcaagcctctaatctcaacgctttgggaggctgaggcaggaggatcgcttgaggccaggagtttgagaccaccttgggcaacataacgagaccccgtctctacaaaaaaaatttaaaaattagctgagcatggtggcatgtgccagtagtcccagctactcgaaaggctaagactggaggatcgcttgagccaatgagttggaggctgcagtgagctataatcacgccactgcactccagcctgggctgcagggtgaggtcctgtctctggaaaaaaaaaaaaaaaaaaaaggaataggtaaaagggacagaggtgaaattttgagtgacttgagtctcttgcagtccctgattacacagaacctttctgggctacttggagcatcacgaatagtctttcctgtacttaccagatttcaagtattcataacttgactccctaagtgtacaagttgggaatagtacagggccaagttcaagtcgcatatgctgtactgttcctcctgcaaatgtggggaaagaagagggagatactagaggaactgaggctccacccattcattcagttgctctaagcaccagaggacttgtttcagaaaaggggagtgggaacgccctcgactttgccctcctccggagcatctctgggacgcagggagtctggctagcgttaataggaaaggttgctcggcagagctgccctggagtactgacttgtctctccctcctttgtcaaggtccatgtttttctggctcttcctgcacactcatccctagattatgagcgttaatgtacgaaatgtgcagagcaaattgaggccaactgtggcatcaatactgcaacttaaacttgacaatcatggtttgctggtcctcaaacaggcactgaaatctcagtatgggtatacgatttaataatcggcccctcccttctatttgtcggttttatgtttctatccttcaatagctgcactgttttctaatgtgctgtagagtttttgaaataatttatgcaagtatttggtttccatgtttacaatttatacagctttcctagcattttaaatggaaatgtcaataaatgctatgaattggtgtcaaa

SEQ ID NO: 24210 - DNA, 639 bp, Homo sapiens
ctttttgacgtccaagagtgacagagcctcaagcactcctggggaccgggctgacttttctccactggcttggttgggaactggcttcttcggagctgtgtagtcttaatttgctttgctgctggctggctgacagctgatgggggactcctcaggacggactcccttccagatgcacccatctccatccttctcaactccccaacctttgtcctccccactcttcgctcgcgcggcggtctgagaccaccaggaccagtttcaggggtttccttctccagcgagacttggcagaacaggctttaaaagcaaaggaggcagcggaagactgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgctttt

SEQ ID NO: 24211 - DNA, 6841 bp, Homo sapiens
cgtgacgggagcatcggcgctggctgcccgggccgcgagcgcagcagagctgtcagcgggcggacgggcagcgggtgacggagcggcgagacgagcgcacagcagtcgcggcccgggagccggagctgccgccgcaccccgggaaggctgccttgccgccggcccgccgaccgcggccggacgaagatgctgttccgcgcccgggggccggtacggggcaggggctgggggcggccggcggaggctccccgccgcgggcgctcgccgccctggagccccgcctggatttgctgctgggcgctcgccggctgccaggcggcctgggctggggacctgccctcctcctccagccgcccgcttcctccttgccaggagaaagattatcactttgaatatacggaatgtgatagcagtggctccaggtggagagttgccattccaaattctgcagtggactgctctggcctgcctgacccagtgagaggcaaagaatgcactttctcctgtgcttctggagagtatctagaaatgaagaaccaggtatgcagtaagtgtggtgaaggcacctattccttgggcagtggcatcaaatttgatgaatgggatgaattgccggcaggattttctaacatcgcaacattcatggacactgtggtgggcccttctgacagcaggccagacggctgtaacaactcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggagatggacaccaccactgacaagtgggtaaaacttacagacaatggagaatggggctctcattctgtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcattatgatccaatttatgttttttctttgtttatattttggggaaaattaaaatttttttaaggtatatttttcccattatttattttcctgaccttaaaacagcttttctactaaaaaatggtgagcaatgaagacaataaatttttcatttttccataggttatcttctcttgatttaaatttcaggaagagttagcatgtgcttgggttatctagatttataattgcctttgaaattccatcctcgttggagctggtaagaagggcttgactgaaagtttgaaggaatctaaaaaacaaaaaagtaagaaaggtaacgagaagccctaattctccattaatgcaaactagctgctagtatcatagaagtcaaatgacttaaaacagtttatgtagtgctagaagtataattaaagtaaataggaaagcttgtcaatcaaatcactggcaaaatcatgaagaagagagtgagaaggtttgtctataagtacagatgactgtatgaaatactggggtaatttcatggtctccagaaaatgtcagtgggacttttgttctttgtcaagcaccagaggttatatggttatttttctgctgcaagactttgaggatgttgactttctcagaaactttttaaaaaaataatccaataaggcaggaattcagttttgaaaaattacatataattgtattcataataagaatgtggttatttcataagcagttatgaaagaattattgttcttattcaaaagtgatccagataattgtgatattttctatggtgggctactggtattagcacgacttggatattatttgttgaaggaagtatgaatgaagttggatttgaccaatttcgtgtaaaccttaattgatttaaaactgggaaagaggggggtttcctggccattgctgatctaaggtgctcttatttgtttccaataaacagtaatctttatagaccttaatgcagatttaaaaaaatagttgtgattggctgagagaggcagggcatatatgtagggaaatgatttgccccaagcattccaatgaagtatgacttgtaacttttgtgtctgaaggtggtgtctttatttttgtggaaaatgggagaaaaatgaataattgtgtttatttggctgattggtaatacactagaccattctgttattattgaatgaatgttttgtgtatatctctgctgttgcacatatgagtataggtgaggttgtcattgtttgctctgggattcagggagggagtcactttgcataaacctttttttgcatttaatttcttgaatgttcttataaagaagacattatgttggcattcttcatttttatcctgccaacagagtgcttatgagcatgtctgcattttgatcaaaatttaaacagaagagtgaaaatacatttgaaatgaaccctttcagaggaaccctggcaaagctgtatagactggacagagtgagaaaacttccacagccacctgtcacctttctcctcatcttccactgtgttcaatatgtatgttccaagccatagagataattgggattttctcccaggtagcttctttcttctcctgtcactggactaaaatctctgacatgtcaaaaatgccttaaattttaatgaactctccgaaaatgtagttgatattggagaatttattttatttctaattttagatattaaatatattttgtcagcacagtcccatctttgggaaggaggtgattttttcccttggattccagtggtttgtcattttatttcaagcactgaagaagtatgacagaaagaatattatggggaaaatatttagaccaatcctggctataaaatttcctttagttttatgcctggcctttgcaaagctcagtgaaatgttgaaaggaataaattaatcatgtttctgtgacttttgattgacacttgttccttttcccccctaagtggtagaagaagttatttgttatttttctaaaaggcacaattttgaagccttaactacttcattaagtcaactgttgcctataacatctcttagcactcgtcaaaacgtatttaaatcaattttccaatggatgagaacatgtcttctgtggataaattatattatgtcatttaacaacattgagcattttgatatgtgttcactgaattaaaaaacctgaatttcattattgttgacttttcccctctttagttactagtaatcacatcctttctaggattaaaaatatttcatagtatttttgtgtagatgtctgtccttattttcttcccaaagaaaaaaggttgtttaaattgattatgtggaagaattacttgggtccagtctttagcatctggggtctccaggtccccaggtgggtcatgattgactgcttcttcaagacccatcttgccaactctcacttgatgtctgtcaatagaactacttcctgtggcacatggttatttctaatgggaggctaatgtgtacataatttctctcttcctcatagaaataaatttctctgggggttgctgtgagaggatgacttcattagccatgtttaaagtgagtgtactgctcacgtttatctttgtacactaagagtatgtagagttgatcttcagagaaactaaacctccctcatatctatttatagtaatcatgaatatgattgcagttgacaggcccaactcctaaactgagtttgcccaaagaaaatgtccttagaggagtaaacttttagaaatctcaacacccgactcattcgttggaagctaaaatggaattcatcttcatactaactggctacagattattctcttgctggattttacttttattttaacatttttacatgagttccttttagaatcataaatgaaagaagtaaaactttaagatgggaatgaataattgaaaagagaattatatttactattataattgatattattcgctattatgattacacttgtctagatcagagcccagcaaacattttttttgtaaagggtcagatagtacatagttttggctttgcagggcatgtgggctctattgcatttactcaactctgccattgtagtatgaaagcaaccacatacaaaatgtaaatggatgggcgtggctgcattccaataaaactttatttatggacactgaaa

SEQ ID NO: 24212 - DNA, 11088 bp, Homo sapiens
gaaatcttttaggcctttagatgttgttctggaaaaactttagtaatggatcaaaggaagaatgagagtattgttcctagtataactcaattagaagattttcttacagaacacaattccaatgttgtttggctccttgttgctaccattttgtcctgtggatggattatttacctcacatattataattcccggaatgttggtcttattttaacactagttcttaacagattatacaagcatggctatatccatattggttccttctctttctctgttctttctggaaaagtcatggttcgtgaaatctattacattacagaagacatgtctattaggattcaagatggattcatcatttttcggtggtggaaaatgtataacccaaaacagaagcaacatgatccaaaggcagaaaccaggttatacatcacagtcaatgactttgaatttcatgtctataatcgctcggatctttatggacgccttcaagagttgtttggtttggagccaacaataattccacctaagaaagatgatgataaaacacgggaaattggaagaacaagaacccaatcgaaaattgaaagagttaaagtaaaaacagaatcccaagaccccacatcttcatggagatcacttattccagtcataaaggtcaatgtgagcacaggacgtttggcctttggaaatcactaccagccgcaaactctgtgcatcaactttgatgatgctttcttaacttatactacaaaaccaccttcaagtcatcttgaccaattcatgcatattgtgaaaggaaagcttgaaaatgttcgagtcatgcttgttcctagtccaagatatgttggtcttcaaaatgatgaaccaccgagattaatgggagaaggttttgtggtgatgcagtcaaatgatgttgacatctactactacatggatgagccaggacttgttccggaagaaacagaagaaaatattgaaggagaaatgagcagtgaggattgcaaattacaagacttgcctccatgttggggactggatatagtttgtggtaaaggaacagattttaattatggaccatgggccgataggcagagagattgtttgtggaagtttttctttccacctgactatcaagttctgaaagtttctgaaattgcacagcctgggagaccaagacagatccttgcttttgaattacgaatgaatattattgcagatgctacaattgatttgctgtttaccaaaaatagggaaacaaatgctgtacatgtaaatgtaggagctggctcatatttagaaattaatattccaatgacagttgaagaaaatggttacactcctgctattaagggacaactcttacatgtggatgccactaccagcatgcaatatcggacccttttagaagcagaaatgttagcattccacatcaatgccagctacccccgaatatggaacatgccgcagacatggcagtgtgaattagaggtttataaagccacttaccacttcatctttgcacagaaaaacttctttacagatttaattcaagactggtctagtgacagtcctccagacattttttcatttgttccatatacgtggaattttaaaatcatgtttcatcagtttgaaatgatttgggctgctaatcaacacaattggatcgactgttctactaaacaacaggaaaatgtgtatctggcagcctgtggagaaacactaaacattgatttttctttgccttttacggactttgttccagctacatgtaataccaagttctctttaagaggagaagatgttgatcttcatttgtttctaccagactgccaccctagtaaatattctttatttatgctggtaaaaaattgccatccaaataagatgattcatgatactggtattcctgctgagtgtcaaagtggccagaaaacagttaaaccaaaatggcgcaacgttactcaggaaaagtctggttgggttgaatgctggactgtcccaagtgtcatgcttacaattgattatacatggcatccaatttatccacaaaaagcagatgaacagctgaaacaatcattatcagaaatggaagagacaatgctatctgtattaaggccatcccagaagacatcagacagagttgtttcttctccctctacttcttcacgcccacctattgatccctcagaacttccacctgataaacttcatgtagaaatggaactttctccagattctcagataactctctatggacctctactaaatgcctttttgtgtataaaggaaaactactttggggaagatgacatgtatatggattttgaagaggttatctcaagtcctgttttgtcactgtcaacatcatccagctctgggtggactgctgttggaatggaaaatgacaaaaaggaaaatgaaggttcagccaagtcaattcatccacttgccttgcgtccttgggatattactgtacttgttaatttgtacaaagttcatgggcgtcttcctgttcatggaactactgatggtcctgaatgccctacagctttcttggaaagactatgttttgaaatgaaaaaaggatttagggagaccatgctgcaacttatcctgtcacccctgaatgtgtttgtcagtgataactatcagcagcgaccccctgtggatgaagtactcagggaaggtcacatcaatttgtcaggtctccagctgagagcacacgctatgttctcagcagaaggtcttcctttgggaagcgattccttagaatacgcatggttaattgatgtgcaggctggaagtcttacagctaaggtcacagcaccacagctggcatgcctcttggagtggggacagacatttgtttttcatgtggtatgtcgggagtatgaactggaaagaccgaaatcagttataatatgtcagcatggaattgatcgtcggttctgtgaatccaagttgagttgtattcctgggccttgtccaacttcagatgatttgaaatatactatgattcgtttagcagtagatggagccgatatttacattgttgagcatggttgtgctacaaatataaagatgggtgcaattcgagttgcaaactgtaatctccacaatcaatcggttggggaaggaatcagtgctgcaattcaggattttcaagtgagacagtacattgagcaattaaataattgcagaattggacttcagcctgcagtgctacggagggcctattggcttgaagctgggtcagccaatttaggacttattactgttgatattgctttagctgctgaccatcattctaaacatgaggcacaaagacatttcttagaaactcatgatgccagaactaagaggttgtggtttttatggccagatgatatcctgaagaataagaggtgtagaaacaaatgtggttgtctcggtggctgcagattctttggtggcacagtaactggcctagatttcttcaaacttgaagagttgacaccttccagtagctctgcattttcaagcacaagtgcagagtctgatatgtattatggacagtctctgctacagcctggagaatggataattactaaagaaattcccaaaattatagatggtaatgtgaatggcatgaagaggaaagaatgggaaaacaaatcagtgggaatagaagtagagagaaaaactcagcaccttagtcttcaagtaccattacgatctcatagttcatcctcttcctcagaagagaacagtagttctagtgctgcacagcctttgttggctggtgaaaaggaaagtccttcatctgttgctgatgaccatttggttcaaaaagagttcttgcatgggacaaaaagagatgatggccaagcaagtatccctacagaaatttcaggaaacagccctgtgtctcctaatactcaggataagtcagtaggtcaatctcctcttagatctcccttgaaacgacaagcctctgtctgttccacccgtcttggaagtactaagagtcttactgctgctttctatggggacaagcagcctgtaacagttggagtccagtttagtagtgatgtctctcgaagtgatgagaatgtactagactcaccaaagcagaggagaagttttggttcattcccatatacaccatcagcagactctaattcatttcatcagtatcgatcaatggattccagcatgtcaatggctgatagtgaagcctacttttctgctgctgaggaatttgagcccattagcagtgatgaaggccctggaacttatccgggtagaaaaaagaagaaaaagcaaacccagcagattgactacagtaggggttccatatatcacagtgtagaagggccacttactggacatggagaaagcattcaggattccagaactctgccattcaaaactcatccttctcaggcttcatttgtttctgcgttaggtggagaagatgatgttatagaacatctatatattgtagaaggtgagaaaacagtggagagtgaacagattactccgcaacaacccgtgatgaattgttatcagacttaccttactcagttccaggtaattaattggtcagttaagcacccaaccaacaaaagaacctctaaatcctcattgcatcgtccccttgatctggatacaccaaccagtgaagaaagttcatcgtcatttgaacagctttctgttccaacttttaaggttatcaagcaggggctcacagctaattctttgctagacagaggcatgcaactttcaggatcaacttcaaatacgccgtatactccattggaaaaaaaactcgctgataacacagatgatgaaacattaacagaagagtggaccctggatcaaccagtgtcccagaccaggacaacagccatagttgaagtaaaaggaactgttgatattgttttgactcccctggtggctgaagctttagacagatatattgaagcaatggttcattgtgctagtacccgacatccagctgcaattgtagatgatcttcatgctaaagtcctcagggaagctgtccaaaatagcaagactaccttttcagaaaatttatcttccaaacaagacattagaggaacaaaaactgagcagtctacaataggaacgactaaccaaggacaagcacagacaaatcttacaatgaagcaagataatgtaacaattaaaggtcttcagactaatgttagcataccaaaggtaaacttatgtttgttacaagcctcagtggaagaatctccaactacggctcctagtaggagtgtgactcatgtttccctagtggcattgtgttttgacagaattgctacacaggttcgcatgaacagaggtgtggttgaagagacttcaaacaatgcagaacctggtagaacatcaaattttgataggtatgttcatgccacaaagatgcagcctcagtcatctggatctctcagatcaaatgctggagcagaaaaaggcaaagaaattgcagctaagttaaacattcatcgagttcatgggcaacttaggggtcttgatacaacagacattgggacctgtgcaatcactgctattccttttgagaagtccaaagttttatttactcttgaagagttggatgaatttacttttgtggatgaaactgatcagcaagctgttccagatgtaactcgaataggtcccagccaagaaaaatggggatggataatgtttgaatgtggacttgaaaatttaaccataaaaggaggaagacagtctggtgctgttttatataacagttttggaattatgggtaaagctagtgacacagaaaggggtggagtgctgacatccaataattcttctgattctccaaccggcagtggctataatactgatgtctctgatgataatcttccatgtgaccggacaagcccttcctcagacttaaatggaaattctgtttcagatgaacaggatgaaggagtcgaatctgatgatttgaaaaaagatctacctctgatgcctcctcctccagattcatgtagcatgaagttgaccattaaagaaatttggtttagttttgcagctcccaccaatgtgagatctcacacacatgcattttctaggcagctgaaccttttaagcactgcaacaccagctgttggtgcatggcttgttcccattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacaatagcagaaattagaaggaagaagatcagcttcaaagttgtattctaa

SEQ ID NO: 24213 - DNA, 3877 bp, Homo sapiens
ccttaacttctgagctcacctattgtctttgggaagaagcagaaggaataatcccataactaccctctgggcttcatttttcattctcctccctcaaagtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacatttaacacaatagctgtctcataaaaaatctaagaacttgtagaattatttgtaaggtatatttagtgtttttttctcttttttcaaatgttgcatagtggtccagatcatctataattaattataagtttcttatgatttacataaggataatttggattctactcttgctgcatattcagaaaaatattatttactgttaattctgatatgaattgtatttaatttgttgtcctaatagtttttaattggttcatttaattttaaagcataggttaaatatctttattttttttaaaatacaagggtccttctgtacttttcatttgaatcatatcctctaactactctgtaagaaacgtttttacatcaatattttgattgattttattgctataccaatacagtcattaattttacttggtgttttcttcaccatatgtctgtttgatttaagtgaatttagatttgtacagttctggaaattttttaaaaaatattatgcagagtaaaacattttaaattact

SEQ ID NO: 24214 - DNA, 1830 bp, Homo sapiens
acttttctccactggcttggttgggaactggcttcttcggagctgtgtagtcttaatttgctttgctgctggctggctgacagctgatgggggactcctcaggacggactcccttccagatgcacccatctccatccttctcaactccccaacctttgtcctccccactcttcgctcgcgcggcggtctgagaccaccaggaccagtttcaggggtttccttctccagcgagacttggcagaacaggctttaaaagcaaaggaggcagcggaagactgtgaattcctttggacaattgatgatatttatcattgtgcccagtttctacaaataaaagatgggtggattattttctcgatggagggttgaaccatatgaaattgccagtattcaactgcttggacttagcaaaatgtcagtttcatatggttaaccctaatgttaacaactcttatggaaactacaatgaactgatattcattaccctcttggattgttgagtatgtaattgacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagtacagtattgaggcagtctgtcagacagaatatgacaaactatgtgggcctgttttcacttaaacatgtttattgaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatc

SEQ ID NO: 24215 - DNA, 6896 bp, Homo sapiens
gctgccgcgggcggtgggcggggatcccccgggggtgcaaccttgctccacctgtgctgccctcggcgggcctggctggccccgcgcagagcggcggcggcgctcgctgtcactgccggaggtgagagcgcagcagtagcttcagcctgtcttgggcttggtccagattcgctcctctggggctacgtcccggggaagaggaagcgaggattttgctggggtggggctgtacctcttaacagcaggtgcgcgcgcgagggtgtgaacgtgtgtgtgtgtgtgtgtgtgtgtgtgtgtgtgtgtgtgtgtgtgtgtaagacctgcgatgacgacgaggaggaacaagtgggacggcgagtgatgctcagggccagcagcaacgcatggggcgagcttcagtgtcgccagcagtgaccacagttcttgaggccaaatctggctcctaaaaaacatcaaaggaagcttgcaccaaactctcttcagggccgcctcagaagcctgccatcacccactgtgtggtgcacaatggcgccccccacaggtgtgctctcttcattgctgctgctggtgacaattgcagtttgcttatggtggatgcactcatggcaaaaaaatcactggtgagcatcatttaagaagacccatgactagactgggctggccgagcccatgttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagctgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccgcagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaatgtaaagtcatcgggcgtaatgaggaagaagggagtgaacatttaccgctttatgtacataacatatgcagtttacatactcatttgatccttataatcaaccttgaagaggagatactatcattcttatgttgcagatagccctctgaaggcccagagaggttaaataacttcccagaggtcatggccaagaagtagtggctccaagaactgaatgcaaattttttaaactgtagagttctgctttccactaaacaaagaactcctgccttgatggatggagggcaaattctggtggaacttttgggccacctgaaagttctattcccaggactaagaggaatttcttttaatggatccagagagccaaggtcagagggagagatggcctgcatagtctcctgtggatcacacccgggccacccctccctctaggtttacagtggacttcttctgcccctcctccttttctgtccttggccatctcagcctggcctctctgatccttccatcacagaaggatcttgaatctctgggaaatcaaacatcacagtagtgatcagaaagtgagtcctgtcttgtcaccccatttctcatcagaacaaagcacgagatggaatgaccaaccagcattcttcatggtggactgcttatcattgaggatctttgggagataaagcacgctaagagctctggacagagaaaaacaggccctagaatatgggagtgggtgtttgtagggctcacaggctaacaagcactttagttgctggtttacattcaatgaaggaggattcatacccatggcattacaaggctaagcatgtgtatgactaaggaactatctgaaaaacatgcagcaaggtaagaaaatgtaccactcaacaagccagtgatgccaccttttgtgcgcggggaggagagtgactaccattgttttttgtgtgacaaagctatcatggactattttaatcttggttttattgcttaaaatatattatttttccctatgtgttgacaaggtatttctaatatcacactattaaatatatgcactaatctaaataaaggtgtctgtattttctgtaatgcttatttttagggggaaatttgttttctttatgcttcagggtagagggatttcccttgagtataggtcagcaaactgtggcctacagcctgtgtgtgcacgccccatgagccgaaaagtgggtcttatgttttcaaatggttaaaaataaataaaaaaatttgaaacatgtgaactatatgacattcagatttgtgttcataaataaagttttattggaacatatcc

SEQ ID NO: 24216 - DNA, 7342 bp, Homo sapiens
tttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagctgtaaactcatctcttttccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaaaaaagaaagaaagaaaatgaatctgccacgccattgcttagaccctttaatgactcttgagtgttcttgggatgaggtccaaatttactaataaggcctgcaaagccctgtgtaattttgctcctagttatggctggcatctgcaccacaactacagccactgccacctccccctgccacacacacattttaaaagtaacaatagtagtgttttctgtgttttgcatatgcagtcttttctcatctcccagccttcttgagcttttcctctgcctgagatacgctcccactcacatagacattgggggcactaaataaaaatagctgtttaattgaattggaatcgttccacttggaacccaagtttggaaattttgctacttcttgttaagctaggccttttattcttgaagttgctatttctcatacaaactcattttatgcattagacacacagtcactattgttatggagaacatagttgtatcagaagaggtatagctttgggtgtggatgtgcgtgtgtcaggggaaagatattctgattatatgatgattttcataaaatatagtatgctgagtttccgaaaatcctaaatgacttagaaatggtgctatatgtggtttgtttgacccctgcaaatctcatgttgaaatttgatccccattgctggaggtgttttgagcatggagcggatccctcatgaatgtcttggcgttgtccttgcagtaatgagttcttgctctatttttcctcccctggaagctgattgtttaaaagagcctggtatcctccctccctttcttctttgcttcctctctcttgctgtgtgatctctgcacacaccagctcccctttgctttctgccatgagtggtctgaggctctcaccagaagccaagcagaggctggcaccatgcttctagtacagcctgcagaactgtaagccaaataaacttcttctttgttttttttttttgtttgttttgtttttttttcagtaaattacccagcctcaggtattccttaacaacacaaatgggctaagacacagggtcatagggatagcaggcacctgagccaagccagaacttagatctcaactgttaatgcaggatgatttgtattgaaccatgaattttacactgcctctcaatgttggtgtcagcatttaaggttatttaaaaaatacaacctgaaggttacataaagtttcatttaaaaaataagaccttataagtctacttttatttccagtggacagcaactacttaatcgtcttaaaactttcttcttacaatattactttacaatattacctgttggatttattatctgtgtacaaatcagttagttgaagggccaaagaataaaggcattttgtgaattatgaatagctattttgaaatggtcatggagactagctactctagaaaattgggagaatatactgtattaagttactatctggtataacttcaattaattgtgaaaattgtagcagagatctagatatagtttatgaacttctaaagagacattaaagggaattcaagtacttgtgtaaagatgaaccaaggtagagatgattgtgaattggtgatctgctgtatgttacagttatgtaatttgacttgtttcaaaattattaaagttttaagtgtatgcattctactggtcaataagtaaatatattcaggctctgaatgtagacagataaatatataaatatagaaagtacatttgttagaat

SEQ ID NO: 24217 - DNA, 6622 bp, Homo sapiens
gctgccgcgggcggtgggcggggatcccccgggggtgcaaccttgctccacctgtgctgccctcggcgggcctggctggccccgcgcagagcggcggcggcgctcgctgtcactgccggaggtgagagcgcagcagtagcttcagcctgtcttgggcttggtccagattcgctcctctggggctacgtcccggggaagaggaagcgaggattttgctggggtggggctgtacctcttaacagcaggtgcgcgcgcgagggtgtgaacgtgtgtgtgtgtgtgtgtgtgtgtgtgtgtgtgtgtgtgtgtgtgtgtaagacctgcgatgacgacgaggaggaacaagtgggacggcgagtgatgctcagggccagcagcaacgcatggggcgagcttcagtgtcgccagcagtgaccacagttcttgaggccaaatctggctcctaaaaaacatcaaaggaagcttgcaccaaactctcttcagggccgcctcagaagcctgccatcacccactgtgtggtgcacaatggcgccccccacaggtgtgctctcttcattgctgctgctggtgacaattgcaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagctgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccgcagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaatgtaaagtcatcgggcgtaatgaggaagaagggagtgaacatttaccgctttatgtacataacatatgcagtttacatactcatttgatccttataatcaaccttgaagaggagatactatcattcttatgttgcagatagccctctgaaggcccagagaggttaaataacttcccagaggtcatggccaagaagtagtggctccaagaactgaatgcaaattttttaaactgtagagttctgctttccactaaacaaagaactcctgccttgatggatggagggcaaattctggtggaacttttgggccacctgaaagttctattcccaggactaagaggaatttcttttaatggatccagagagccaaggtcagagggagagatggcctgcatagtctcctgtggatcacacccgggccacccctccctctaggtttacagtggacttcttctgcccctcctccttttctgtccttggccatctcagcctggcctctctgatccttccatcacagaaggatcttgaatctctgggaaatcaaacatcacagtagtgatcagaaagtgagtcctgtcttgtcaccccatttctcatcagaacaaagcacgagatggaatgaccaaccagcattcttcatggtggactgcttatcattgaggatctttgggagataaagcacgctaagagctctggacagagaaaaacaggccctagaatatgggagtgggtgtttgtagggctcacaggctaacaagcactttagttgctggtttacattcaatgaaggaggattcatacccatggcattacaaggctaagcatgtgtatgactaaggaactatctgaaaaacatgcagcaaggtaagaaaatgtaccactcaacaagccagtgatgccaccttttgtgcgcggggaggagagtgactaccattgttttttgtgtgacaaagctatcatggactattttaatcttggttttattgcttaaaatatattatttttccctatgtgttgacaaggtatttctaatatcacactattaaatatatgcactaatctaaataaaggtgtctgtattttctgtaatgcttatttttagggggaaatttgttttctttatgcttcagggtagagggatttcccttgagtataggtcagcaaactgtggcctacagcctgtgtgtgcacgccccatgagccgaaaagtgggtcttatgttttcaaatggttaaaaataaataaaaaaatttgaaacatgtgaactatatgacattcagatttgtgttcataaataaagttttattggaacatatcc

SEQ ID NO: 24218 - DNA, 1592 bp, Homo sapiens
aaaggacccggctgctcgcgggcggcgcagtcgccgcagcagccgagtctgacggcgccggttcgctgcccggtccgcccgcggtgagagatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctg

SEQ ID NO: 24219 - DNA, 3563 bp, Homo sapiens
atctacttcccagagcgcctggccgagaaataggaaagagggcagccagtaggcaggccaatacccaacaaaagtagaatcgagacgccctgagttcagaagttcttgaggccaaatctggctcctaaaaaacatcaaaggaagcttgcaccaaactctcttcagggccgcctcagaagcctgccatcacccactgtgtggtgcacaatggcgccccccacaggtgtgctctcttcattgctgctgctggtgacaattgcaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtact

SEQ ID NO: 24220 - DNA, 1580 bp, Homo sapiens
cccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatggagatggggcttcctcatattgcccaggctggtcttgaacacctgagctcaagtgatctgtctacctcgacctctcaaagtgctgggattacaggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttca

SEQ ID NO: 24221 - DNA, 1698 bp, Homo sapiens
acgcgccctggcagcaccatgagccgccagcttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggaccacgggacgctgagggcattgccgagtggctgcgacggcgggtggggcccagtgccatgcggctggaggacgaggcggccgcccaggcgctgatcggtggccgggacctagtggtcattggcttcttccaggacctgcaggacgaggacgtggccaccttcttggccttggcccaggacgccctggacatgacctttggcctcacagaccggccgcggctctttcagcagtttggcctcaccaaggacactgtggttctcttcaagaagtttgatgaggggcgggcagacttccccgtggacgaggagcttggcctggacctgggggatctgtcgcgcttcctggtcacacacagcatgcgcctggtcacggagttcaacagccagacgtctgccaagatcttcgcggccaggatcctcaaccacctgctgctgtttgtcaaccagacgctggctgcgcaccgggagctcctagcgggctttggggaggcagctccccgcttccgggggcaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaagccctatctcctgagccaggagataccccctgattgggatcagcggccagttaagaccctcgtgggcaagaattttgagcaggtggcttttgacgaaaccaagaatgtgtttgtcaagttctatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtgattgaatacaaaagcaccagggacctggagactttctccaagttcctggacaacgggggcgtgctgcccacggaggagcccccggaggagccagcagccccgttcccggagccaccggccaactccactatggggtccaaggaggaactgtagctgcccccgtgtcacccccgccatcactgctggacaggagccacccccttgggtaccagagggagctgtgcattgtgaataaagagtgagcttggttctgga

SEQ ID NO: 24222 - DNA, 1575 bp, Homo sapiens
gcaccatgagccgccagcttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggaccacgggacgctgagggcattgccgagtggctgcgacggcgggtggggcccagtgccatgcggctggaggacgaggcggccgcccaggcgctgatcggtggccgggacctagtggtcattggcttcttccaggacgaggacgtggccaccttcttggccttggcccaggacgccctggacatgacctttggcctcacagaccggccgcggctctttcagcagtttggcctcaccaaggacactgtggttctcttcaagaagtttgatgaggggcgggcagacttccccgtggacgaggagcttggcctggacctgggggatctgtcgcgcttcctggtcacacacagcatgcgcctggtcacggagttcaacagccagacgtctgccaagatcttcgcggccaggatcctcaaccacctgctgctgtttgtcaaccagacgctggctgcgcaccgggagctcctagcgggctttggggaggcagctccccgcttccgggggcaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaagccctatctcctgagccaggagataccccctgattgggatcagcggccagttaagaccctcgtgggcaagaattttgagcaggtggcttttgacgaaaccaagaatgtgtttgtcaagttctatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtgattgaatacaaaagcaccagggacctggagactttctccaagttcctggacaacgggggcgtgctgcccacggaggagcccccggaggagccagcagccccgttcccggagccaccggccaactccactatggggtccaaggaggaactgtagc

SEQ ID NO: 24223 - DNA, 1648 bp, Homo sapiens
agcaccatgagccgccagcttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctatgccccgtggtgtgggcactgccaggccctggcccccgagtacagcaaggcagctgccgtgctcgcggccgagtcaatggtggtcacgctgaggagtttggtgtgacggagtaccctacgctcaagttcttccgcaatgggaaccgcacgcacccggaggagtacacaggaccacgggacgctgagggcattgccgagtggctgcgacggcgggtggggcccagtgccatgcggctggaggacgaggcggccgcccaggcgctgatcggtggccgggacctagtggtcattggcttcttccaggacctgcaggacgaggacgtggccaccttcttggccttggcccaggacgccctggacatgacctttggcctcacagaccggccgcggctctttcagcagtttggcctcaccaaggacactgtggttctcttcaagaagtttgatgaggggcgggcagacttccccgtggacgaggagcttggcctggacctgggggatctgtcgcgcttcctggtcacacacagcatgcgcctggtcacggagttcaacagccagacgtctgccaagatcttcgcggccaggatcctcaaccacctgctgctgtttgtcaaccagacgctggctgcgcaccgggagctcctagcgggctttggggaggcagctccccgcttccgggggcaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaagccctatctcctgagccaggagataccccctgattgggatcagcggccagttaagaccctcgtgggcaagaattttgagcaggtggcttttgacgaaaccaagaatgtgtttgtcaagttctatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtgattgaatacaaaagcaccagggacctggagactttctccaagttcctggacaacgggggcgtgctgcccacggaggagcccccggaggagccagcagccccgttcccggagccaccggccaactccactatggggtccaaggaggaactgtagctgcccccgtgtcacccccgccatcactgctggacaggagccacccccttgggtaccagagggagctgtgcattgtgaataaagagtgagcttggttctgg

SEQ ID NO: 24224 - DNA, 2338 bp, Homo sapiens
agcgccttccggcccgcccccgcgcggccgcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaa

SEQ ID NO: 24225 - DNA, 1851 bp, Homo sapiens
gtgcttcaaacaggaattaatagaatcccaccaggtggtgtttgtgaggcgtagatggcgaggatatctgcagctgcagtttgctcattctcacggctgcactgcattgcactgtgtgagcagaacacaatttatccttccactgctgatgggcatttgggcggtttgcagtttgggatctggccagttctgctgttgtgagcattcttaagcctgcctttcggtgaattcacacgcccgtggggctcaccaacttctcctgcccactccctatcaaggaaaagtcccataatgtatccatcaaccaccatggctaatgcacccggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgt

SEQ ID NO: 24226 - DNA, 986 bp, Homo sapiens
attgcactgtgtgagcagaacacaatttatccttccactgctgatgggcatttgggcggtttgcagtttgggatctggccagttctgctgttgtgagcattcttaagcctgcctttcggtgaattcacacgcccgtgggaagttcatatgagccataacaaggattggaagaagttttagaagtaacctcctgggagtccatgaattagcagcagtgagaggctagaggcctgacaaagaattgagaagcagctgctatatcccaagtggcaaatgccagtgtggatggagaagagagagcttcattctgtggcaggaaagcttggctgctgacaatgagactgcacccttgggatttgtcccttggattctttagcatctgagctctaacctctgaaacacaagaaaaaatgagcaagatgtttgctcagcatcaattcagataccgctgaatagaaggcaacacccaaccacacagccagaggcctcctgggtaaatcggggactgctctcctctgacccctctttctcctgcctctaccccttggcttcacagcaattattcattttttaacactcaaatgctgggtacctgttgcctatgtcggggcacgctgttactccctacacacaggtaaaattgattaaccgaatcttgccctccactggcttactgtgcaacggtagagactggaagcaacagacgagggtgagctttggaagagctgatgaggccatgattaatttcaactgagaggacgctcactctcagagcacagcttccagaggagagaagatacccccagcatccatgagaagagacctccgggagaagcttgtgtgggtgtgccgaccactggccccagttgaggtcccagccaacatcagctccgacttccagccatgctcaccaacttctcctgcccactccctatcaaggaaaagtcccataatgtatccatcaaccaccatggctaatgcacccg

SEQ ID NO: 24227 - DNA, 1805 bp, Homo sapiens
acgctgcagggctgaagcggcggcggcggtggggactgcacgtagcccggcgctcggcatggctctcctggtgctcgcctgcttgtaacagcatgaagaggagaggactgacgttattgctgtccttgattggcaaagagaagtgaaagtacctaattctgccacagtctacctaatgatgctctgtggattatacccctgcattctccagcccttcggttagaaatttgggtctatctaattatatgatcttaggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaag

SEQ ID NO: 24228 - DNA, 2278 bp, Homo sapiens
ggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgttt

SEQ ID NO: 24229 - DNA, 2932 bp, Homo sapiens
ttgttgtgggcgcctctggcgggggtggcgggggaagagatagggagtccggaggtaggggctgcagctgtctcatgggctcggctttttcaccttccagttagcctccctgccccccatggggagctggggctgggggcagggtgctctcgtaggggggattgggaaagctccccgtggccgcttcctcttcctcctttgcagtcccgggctcctgtcaggcgctcttctcagacccccgggaacttggcttcggccgccccgcccctccgtggatcccagtagcccccgccccggactcggctttccccggctgctcgcttgtcaggaagcgcctggggtgccccgcttgtgggaagcgcgatcccggggcgatagggtggggatctgggggagaagctctggtaaagtttagcgagccccgggccggcgttggggttcggctgagaggtagtgagcgggacgttactctttctctctgattccgggcagccgaggggagaaaccccctcgaagagtgtgtctttggaagcagtgttgggagggggggatgcagctacctctctcccttcttttgccttagctggtgtggagggtgagaggagcctttgggggtctctgcacacaccatgatggcgatgctgtagctgatggagaacaaccaaatgccagatttgattctgtagagtttttcctgtggaatatcctcaccgaaagagcttttctcctaataacttcacaatgtttacactccaagattcgtatgttaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgttt

SEQ ID NO: 24230 - DNA, 2761 bp, Homo sapiens
gccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggtttatttatggagattcttagttcctgttcagattgtgatgagatccaattcatggaagatggatcctggtgcccaatgaaacccaagaaggaggcatctgaggtttgccccccgccagggtatgggctggatggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctccatttatatatctaagttcacagtgtttcttattcccccctaagcttctagaggctcatggccctgtagttaggcctggctcattctgcaccttgccagggaggtggaaggaccctgtgccctccttcccaatcttctttttcaggctcgccaaggcctaggacctatgttgtaattttactttttatttctaaagttgtagtgaagctctcacccataataaaggttgtgaatgttc

SEQ ID NO: 24231 - DNA, 1235 bp, Homo sapiens
ggaccgaacttctgccgtgcggacagcaggagcagcgccgagccccattcccccacctctccagctcgccctctgagcctcccgagccctctctccatttcccacaattgtgctgcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacgggtgagcacagctaaagcaggtgcctggaaaagcctgctgagggtgaaggggaaccatccagtgtcctgggttggggaagcattttcctctttatgagtctgtctctggtcctcatggaacaaaagtgggcagtggtggtatgagaagcagaggctaattgtctaccccctgcctccaagtagaattactccttgtctgtgtacctggtgaggcagttgactgcaggaacccttctacaaaaactcagagcaaagggtatccggaacccagaccactcgcgggcactgagtgagtaacatctttcctctcttccccacctgatctggattcaagtcttcct

SEQ ID NO: 24232 - DNA, 2901 bp, Homo sapiens
gcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggtttatttatggagattcttagttcctgttcagattgtgatgagatccaattcatggaagatggatcctggtgcccaatgaaacccaagaaggaggcatctgaggtttgccccccgccagggtatgggctggatggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctccatttatatatctaagttcacagtgtttcttattcccccctaagcttctagaggctcatggccctgtagttaggcctggctcattctgcaccttgccagggaggtggaaggaccctgtgccctccttcccaatcttctttttcaggctcgccaaggcctaggacctatgttgtaattttactttttatttctaaagttgtagtgaagctctcacccataataaaggttgtgaatgttc

SEQ ID NO: 24233 - DNA, 952 bp, Homo sapiens
gctaggcggggcggagctccggcccgggcggagccgcggccgccgcgtccggctgctggaccgaacttctgccgtgcggacagcaggagcagcgccgagccccattcccccacctctccagctcgccctctgagcctcccgagccctctctccatttcccacaattgtgctgcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacgg

SEQ ID NO: 24234 - DNA, 2055 bp, Homo sapiens
aatcgcggccaccgccaggtggaacggcaggtgggttcaggtaccagcctggccgggacccggctgtgggaccaacgcttccggtgagcgacagaggcagctccccagggcctggagacccgtggggcggactctgggatctgagcctatcgccctggcctggagcccccctttgtacctattccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagccgatgctgacggatctgaacacgtacctcaacaaagccatcccggacactcgcctcaccatcaagaagtacctggacgtgaagtttgagtacctgtcgtactgcctgaaggtgaaggagatggatgacgaggaatacagctgcattgccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacgtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgca

SEQ ID NO: 24235 - DNA, 2164 bp, Homo sapiens
ggcggggttagacgctgtcagcctgtccagaccgttcctctgttttcgcttgttcctactaacagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcaggtgggttcaggtaccagcctggccgggacccggctgtgggaccaacgcttccgttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagccgatgctgacggatctgaacacgtacctcaacaaagccatcccggacactcgcctcaccatcaagaagtacctggacgtgaagtttgagtacctgtcgtactgcctgaaggtgaaggagatggatgacgaggaatacagctgcattgccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacgtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgca

SEQ ID NO: 24236 - DNA, 954 bp, Homo sapiens
agaccgttcctctgttttcgcttgttcctactaacagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcagttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagc

SEQ ID NO: 24237 - DNA, 559 bp, Homo sapiens
ggcactgctgtcccgtatgaggtggtggagggaggggtggcgttggcatttaggcacttgggttccttaaatcctatgctcctttctctcccggatccagttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgca

SEQ ID NO: 24238 - DNA, 544 bp, Homo sapiens
aagtgacgtgacaatcgcggccaccgccaggtggaacggcaggtgggttcaggtaccagcctggccgggacccggctgtgggaccaacgcttccgttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattggccagcgcctcggcttccatggcccagggcctcactcttcata

SEQ ID NO: 24239 - DNA, 631 bp, Homo sapiens
actcaattagccacctaaggagagagtagggcggggcttccaccggccgtgggatatgtggataatcatccttctgtatctttcttccatggctcctggggcagctggggaagcaagctggatgggcctggccccatgctgccggatgaggtggatgcctggctgtggctctgggagagccaacctcccccagggaacccactttacacaatagcagtggcagcagaggctggcgaggagacaagattcggactctggggagcactgatagcatttcccgagcctcagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcagttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattgga

SEQ ID NO: 24240 - DNA, 1736 bp, Homo sapiens
tgctggcaggtggggcgcgggccggcgcgagctgaccgagcactcggcgggcgcggcgggactgcggcccgtggcggcgtgcgcggggacctgcgctgactaggtccggggaagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcattt

SEQ ID NO: 24241 - DNA, 4163 bp, Homo sapiens
atccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacattttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcattttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgta

SEQ ID NO: 24242 - DNA, 588 bp, Homo sapiens
aacttctagaatccatcgatgtggaacacttcagtttgtttaacgtaggagactccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgctta

SEQ ID NO: 24243 - DNA, 1595 bp, Homo sapiens
tatccgcacaggctctagaacttggtttcttgaagaagttgtaggaaagaaagtttatcagaattttttaaacctgtctcagaaataacaacatattttaatcagagatttgctgaagcttcagagatcacctgccaaacacaggctgaacctgacagcatgtcacaccaggatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaactttggtctgtgtatgtgtgtgtgttttactttaatatgaattatacaaaatactagttgttttacactctcttttcttattcttagggcttttgtgtatgtctgacttgtttttaaataacttcctcagcaatgcagaccttaatttttatatttttttaaagtagctaacatagcagtaggcacttaagcatttagtcaatgatattggtagaaatagtaaaatacatcctttaaatatatatctaagcatatattttaaaaggagcaaaaataaaaccaaagtgttagtaaattttgatttattagatattttagaaaaataatagaattctgaagttttaaaaatgtcagtaattaatttattttcattttcagaaatatatgcatgcagttatgttttatttgattgttgacttaggctatgtctgtatacagtaaccaaataaactctttcactattaaagagatttcttactga

SEQ ID NO: 24244 - DNA, 1043 bp, Homo sapiens
gggttatttttagcaatctggctcacactgagggcttcctgctctattcagcaaatgtgcaaatggatgctgcaggaccgtaacagtagacattgatgaagatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaa

SEQ ID NO: 24245 - DNA, 556 bp, Homo sapiens
ggttatttttagcaatctggctcacactgagggcttcctgctctattcagcaaatgtgcaaatggatgctgcaggaccgtaacagtagacattgatgaaggttgtgatcaatgattagactctcaagcctgttgtgtttttgatctagccatgcctttcaaccactgtggtgaacatttacttctgaataggctcatcttcttcatatgcacattctatttgtagatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggt

SEQ ID NO: 24246 - DNA, 1561 bp, Homo sapiens
gaaaaaagctaccgtggcacgtgccccggggagtgatgcggtggcccggtttgcacggagagcgggacaccgcctggggagccgcgctcgtagcctgggggcgggacgcggcggccgctccctccgcccccgagtagctgccaccgcctggctgcgccccagcccagtagctcagacgcggccgcatcccggtggactgtagaggcggcagcgagctagagcccgagtcgcagctccgggccgcagagcgctgggcgagcgcgagcgccagggcaccggcagggcaggcagctgcgcgcggctggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttcacctgtgccacaggccaccatggatctgcacctcgatgcccttcggagtcatgagagtgcaagcaatagcagctcaggaagcagcagcagaggagaccagaaaggtcactacctttgcatgaacaacaatggcaaccaggataccatgcttggttctccatgatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaa

SEQ ID NO: 24247 - DNA, 1398 bp, Homo sapiens
gaaaaaagctaccgtggcacgtgccccggggagtgatgcggtggcccggtttgcacggagagcgggacaccgcctggggagccgcgctcgtagcctgggggcgggacgcggcggccgctccctccgcccccgagtagctgccaccgcctggctgcgccccagcccagtagctcagacgcggccgcatcccggtggactgtagaggcggcagcgagctagagcccgagtcgcagctccgggccgcagagcgctgggcgagcgcgagcgccagggcaccggcagggcaggcagctgcgcgcggctggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaa

SEQ ID NO: 24248 - DNA, 1811 bp, Homo sapiens
gaaaaaagctaccgtggcacgtgccccggggagtgatgcggtggcccggtttgcacggagagcgggacaccgcctggggagccgcgctcgtagcctgggggcgggacgcggcggccgctccctccgcccccgagtagctgccaccgcctggctgcgccccagcccagtagctcagacgcggccgcatcccggtggactgtagaggcggcagcgagctagagcccgagtcgcagctccgggccgcagagcgctgggcgagcgcgagcgccagggcaccggcagggcaggcagctgcgcgcggctggagtcatgctatactgaaaagacacttcatcaagataactctgggagaagcagaaaaccctgtgccagggacaggaaagataggaatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaactttggtctgtgtatgtgtgtgtgttttactttaatatgaattatacaaaatactagttgttttacactctcttttcttattcttagggcttttgtgtatgtctgacttgtttttaaataacttcctcagcaatgcagaccttaatttttatatttttttaaagtagctaacatagcagtaggcacttaagcatttagtcaatgatattggtagaaatagtaaaatacatcctttaaatatatatctaagcatatattttaaaaggagcaaaaataaaaccaaagtgttagtaaattttgatttattagatattttagaaaaataatagaattctgaagttttaaaaatgtcagtaattaatttattttcattttcagaaatatatgcatgcagttatgttttatttgattgttgacttaggctatgtctgtatacagtaaccaaataaactctttcactattaaagagatttcttactg

SEQ ID NO: 24249 - DNA, 1875 bp, Homo sapiens
gactgcgcatgcgcgtcactagacgacacggctgtcttctttcctggagaatttctcaaggactgctggctggaaacttaacggctaatgtggatctgaccgtagtttgccaaattaagaaaacgtttttaccctgttgaagatttgctttaacttcaaaagtgatgacaagaaagtatggacaccccttcaggaccaacctgataagtcactggtttttctttcgtttaaagatgacacactctgaaattaatttgattttgagatttgagaacttggacatacatacttcctatggaaggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaactttggtctgtgtatgtgtgtgtgttttactttaatatgaattatacaaaatactagttgttttacactctcttttcttattcttagggcttttgtgtatgtctgacttgtttttaaataacttcctcagcaatgcagaccttaatttttatatttttttaaagtagctaacatagcagtaggcacttaagcatttagtcaatgatattggtagaaatagtaaaatacatcctttaaatatatatctaagcatatattttaaaaggagcaaaaataaaaccaaagtgttagtaaattttgatttattagatattttagaaaaataatagaattctgaagttttaaaaatgtcagtaattaatttattttcattttcagaaatatatgcatgcagttatgttttatttgattgttgacttaggctatgtctgtatacagtaaccaaataaactctttcactattaaagagatttcttactg

SEQ ID NO: 24250 - DNA, 1153 bp, Homo sapiens
aaaagtctgagcccatgttctttaaaatgttgatggtggttgtctgggtgtggaattatgagtgacttgttttgttctttgtacttttctgtgctttttgctttgttttcaataagaggcaataactgtcattttgacagaagccactgtgctggggaactggagctgtcctctctgcagaatgcatctggacttacctctgcccccttgccttctgtccccacaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 24251 - DNA, 338 bp, Homo sapiens
gaggcgctgcggaccggcggcccaggcacggagaggcggcgagaccgcagaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagagatggatctcactatgttgccctggctggtctcaaactcctag

SEQ ID NO: 24252 - DNA, 1180 bp, Homo sapiens
aacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 24253 - DNA, 1489 bp, Homo sapiens
gggcgctaggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccagtaagatagagactgccactctctgggaaccttgctgtgtagctgagcctcagcaagtttgataatacagacacagcaggaggcctggggaggacccagcatgcccggccaccaagcagtgatgcagctggactgttccgcagctttccagagacctccatggaagcacagacttccatgggttgaagagagtttgtgtcacaattccagtccctagccctggccctgtgtgaagtagtaacaccgccctgccagtaggatatagctgctgaggaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 24254 - DNA, 1443 bp, Homo sapiens
ccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttgtggtggtgaggaggtgatgttctggaaggaaggtacctagactttgtggtccctgccaggaagtggagagtggaaatgtggaatgcctcacactcctcaactagaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 24255 - DNA, 1338 bp, Homo sapiens
ccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 24256 - DNA, 1191 bp, Homo sapiens
ccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcagaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 24257 - DNA, 2281 bp, Homo sapiens
gggaatgacagtttgctgcagtcccgtcaatgggggaatctgcccgagctctgcctgcattttgagcagcaaagcagctccagccaccaagaccgttgcctgcgctgtcttaggccagcccatgctgtctgccagccgcttgttgcgctgccttggggactgggaacacacccagccccggtccccatctgttgcagacatgcagtggcagcagctcggagcacagccgaaccctagaaattgcctgtgctgaaggggctgggaaaccccttctctgatggacctttcgagtgaggcagcaggatttgtcagagctgggagtgccgcccgtccccgtcactcgcatcctgccatccagcagcttacaagcctgcactgcttattagcatctggaagagaagacctccaggaccccttggggctgagacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcc

SEQ ID NO: 24258 - DNA, 2318 bp, Homo sapiens
gcggccgcgccacctgcggcggcggcggcggcctcgggcgggtgggggcagcgctcccgctccgcccccggcccccgctgcccgcgtcccctgccaggcccctcctcccggcggcgcggcagagccaggccccagcgctcggccggccgcgagcccgccggccggggacgagcgtcgcagctcatgctgatcgctgtcctcctcctccccctcaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgttttttttttgttttgggtttttttttttcagattgaaaaattaaaatagatcctactatctacca

SEQ ID NO: 24259 - DNA, 4229 bp, Homo sapiens
agagcgacgcggtggcggcggcagcgccagccccctcctcccccgggaagtcggccgggcttgaggccgggccccagacgtcccgcttcgccccgagtcgccgccgatggtccccggagctcctgcccccagtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccaaacctacggcaaagccagcaacagtagcagcctgctcccatttgctggggaggagatcatcttgttcccctggccccccactctccctccatgtccatccaaaaaccataaaatcactgggttccacatcagcctccatgaggccaagccttgtacctgcaaggctcttggcctaaccattcctctgtcctcttctctggcctgcctggggagcccgtgaaggccgcacgggtgcctccagcctgagacatcaggggagagcctgcagctgagttcagcagaaaggaggaatcctggccctcaggaagaagatagtcacatgtttttcttccttgtccccacggcccccagaacaacattctccctgctggcagcccttccatgtctccaaacctgggtcagagtgaaaggacctttgggggtgggtgggagcaaagggcccacctgctggttggtgaaagcagtggtgccggagtgctaggtaccgcacgagagggtgcgggggcttgggaagcagaccagggttggacaaaaccccatgagggcggggagctggaagaaaagtctcttggggacctctggggcaaggagctgagaagtcctgcagcaccaggtgagacttgcttacagtggatgccacttctaggcctctggaccgcagatgccctcctccctcctgcacacctggcctcctgggcctccaggtaaagagagagagccagcccagccctgtttcccctcagtcctcctttgctcctgctgcttctcccaacagcccactgttaggaggtagtagaccccagcctcaaggctctgaccttcttcatgtgggcacagagggtcctgacactctggcagggcctgagctggggcaggcctccctcagggccaggggcgatggcaccccggggacaggcagacctccttcctgccgtcagcacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagctcctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtcaacctggc

SEQ ID NO: 24260 - DNA, 1678 bp, Homo sapiens
agttctggcgctgctgccttcctgagtgagcggtggagggaaccctagaggacagagcccccagcccggcagcaggccccctctccgcccgccaccacggaggagaaggaggacagccagcccctccagccctggcctggcccagcgggggcagtaagctcctacttgcccccagcttggtgcccacacgggcccagtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcctctaccctgccaactacgtggaggctatctagaggccccctccctccatactcccgtcactcctccccactgccgcccctcccctcccactctcgtctccttcccctcgccattagttccgacacttgtgaaactccgagaagtgctgtggtctcagcaatgcacctgt

SEQ ID NO: 24261 - DNA, 4271 bp, Homo sapiens
gccttcctgagtgagcggtggagggaaccctagaggacagagcccccagcccggcagcaggccccctctccgcccgccaccacggaggagaaggaggacagccagcccctccagccctggcctggcccagcgggggcagtaagctcctacttgcccccagcttggtgcccacacgggcccagtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccaaacctacggcaaagccagcaacagtagcagcctgctcccatttgctggggaggagatcatcttgttcccctggccccccactctccctccatgtccatccaaaaaccataaaatcactgggttccacatcagcctccatgaggccaagccttgtacctgcaaggctcttggcctaaccattcctctgtcctcttctctggcctgcctggggagcccgtgaaggccgcacgggtgcctccagcctgagacatcaggggagagcctgcagctgagttcagcagaaaggaggaatcctggccctcaggaagaagatagtcacatgtttttcttccttgtccccacggcccccagaacaacattctccctgctggcagcccttccatgtctccaaacctgggtcagagtgaaaggacctttgggggtgggtgggagcaaagggcccacctgctggttggtgaaagcagtggtgccggagtgctaggtaccgcacgagagggtgcgggggcttgggaagcagaccagggttggacaaaaccccatgagggcggggagctggaagaaaagtctcttggggacctctggggcaaggagctgagaagtcctgcagcaccaggtgagacttgcttacagtggatgccacttctaggcctctggaccgcagatgccctcctccctcctgcacacctggcctcctgggcctccaggtaaagagagagagccagcccagccctgtttcccctcagtcctcctttgctcctgctgcttctcccaacagcccactgttaggaggtagtagaccccagcctcaaggctctgaccttcttcatgtgggcacagagggtcctgacactctggcagggcctgagctggggcaggcctccctcagggccaggggcgatggcaccccggggacaggcagacctccttcctgccgtcagcacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagctcctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtc

SEQ ID NO: 24262 - DNA, 1843 bp, Homo sapiens
aggactcgggccggagcgtggccggacccccacccgccgaggggcccagggaggacgcggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaaca

SEQ ID NO: 24263 - DNA, 1832 bp, Homo sapiens
aggactcgggccggagcgtggccggacccccacccgccgaggggcccagggaggacgcggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaac

SEQ ID NO: 24264 - DNA, 554 bp, Homo sapiens
agcggcaggactcgggccggagcgtggccggacccccacccgccgaggggcccagggaggacgcgcgcgtggggacacacaaatcagaatcctggaagcctctgtcggtgactgaagatagacactgtcctgtcagccacaactccatgggttatacaccccggctgaagggtcacccggggctacaggagcaaggacagagaaacaggggaagtgactgaggagaagatgccttaattggaggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggaga

SEQ ID NO: 24265 - DNA, 683 bp, Homo sapiens
aggggctgcccgggaaagaagcccttgggcgcagcctgtgactcaggttccagggatgggccaggcagaatggctgagctccctcccaggggcaagcccccagcttctggaagaggttggggctggtctggggccgggtaccttcaggcctcaggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccc

SEQ ID NO: 24266 - DNA, 1560 bp, Homo sapiens
aagaccaagttcaacaagtttggccaagaagtctagagcttcggtggctaggcctggccctgccgctccgcgtggctccacgggctccgagttatgcagctccgggcggcaaggggtcctgtcgaggggcgcggtccataagggttgaggccagaggcgcgtagcctctgggcgccgagctctggagtggaggctggggttcggagtgcgtcatctggaagcaggcaccccggccggcaggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagtt

SEQ ID NO: 24267 - DNA, 563 bp, Homo sapiens
gtcactcaagggaaggcaacagaggccctagcctgggcaggagtcctctcatcggcagttgggggagtggggccttctgcccaccgcccacccccgcctgccatttaatccctggctggatcgtgtgacctgcctggcattctcctccctggaatccggcgcttctgacagcagttgctatattgggggtgccgggcaccgccctggacgctctaggcccccaccctcacccccgctctgttctccttcaaggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggaga

SEQ ID NO: 24268 - DNA, 654 bp, Homo sapiens
gcaggactcgggccggagcgtggccggacccccacccgccgaggggcccagggaggacgcggcagagtcacggtggcagcattgagagttggacacccgggtccttgaagtgatctctaggccccagaaacataatgtccagctttcctgcttacccctctgccctccacagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaagg

SEQ ID NO: 24269 - DNA, 2009 bp, Homo sapiens
aagaccaagttcaacaagtttggccaagaagtctagagcttcggtggctaggcctggccctgccgctccgcgtggctccacgggctccgagttatgcagctccgggcggcaaggggtcctgtcgaggggcgcggtccataagggttgaggccagaggcgcgtagcctctgggcgccgagctctggagtggaggctggggttcggagtgcgtcatctggaagcaggcaccccggccggcaggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacac

SEQ ID NO: 24270 - DNA, 2262 bp, Homo sapiens
gctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 24271 - DNA, 2253 bp, Homo sapiens
gctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 24272 - DNA, 2680 bp, Homo sapiens
ccgccccctcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtctgcagggaactggccaggcaagggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgctggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgaccggaaacatcaaaatccaccccttcttcaagaccataaactggactctgctggaaaagcggaggttggagccacctttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataa

SEQ ID NO: 24273 - DNA, 2810 bp, Homo sapiens
ggcctggcagggcgaggcctggcgggggcggggcctggcgggggcggggccggcggcacctgggtgaggtcgctcggccccgccccctcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgctggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgaccggaaacatcaaaatccaccccttcttcaagaccataaactggactctgctggaaaagcggaggttggagccacctttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaggagcacaagctgtttgaaccaccaggtttatttgtgtgtctaaataaacaccaaatagtaccaa

SEQ ID NO: 24274 - DNA, 589 bp, Homo sapiens
aaggattagggagtcctgagccccaggctgctctgctcagtcttggaaggcctcacgcaacccccttcacaaagcctgcccgattgtgtcctcaagggacaatttatagcatgcaatgacagtgcggagggcaggtctgtctggggagatgaaacgacctgtgcgattacaggagattcctactttcctcgcccccagtcctcaaggtcttctcagaggttcccactaggaggccggctgcagtgccctggacgaccctcacacccaggacctcagttgctccatccaaggaatgggcgagctcaggtcttcctgactttcctggagaacaaagaggccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcaga

SEQ ID NO: 24275 - DNA, 562 bp, Homo sapiens
aaactgagaaactgagccgcggtcagcgaaagtcccgccgcgccgagacctgccggtctgcagggaactggccaggcaagggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtgg

SEQ ID NO: 24276 - DNA, 3582 bp, Homo sapiens
gggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctgcctttccccagggctgcctcgactcctgcacctgtcccgagggctggcctgagacgggactcccggttctcccgctgcgaagcagcgcggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgctgcgcacgaccggcgcctcggacaccttcgagggttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaa

SEQ ID NO: 24277 - DNA, 562 bp, Homo sapiens
atgcttatcggggtgtaatgcctgcctcctgctgctgctccaagctcctccaggagaaggacgctgcttctgcctggtccaggatcgtatcagggtctggggctgcctcgactcctgcacctgtcccgagggctggcctgagacgggactcccggttctcccgctgcgaagcagcgcggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgctgcgcacgaccggcgcctcggacaccttc

SEQ ID NO: 24278 - DNA, 4950 bp, Homo sapiens
ggttgcgcccgccctaccccggaatgtgggcctttggagcgagcgaagtgggagggaccgacgcaggaggtgtcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgtttaaaaaaaaaaaaaacactgcattaaaaaagtatctgttgcattaaggcacatagtgggattacatcataaacctcccataatttttgtcattctgtgttaaatcatttcagggtttaattttgaaataaaagattaatataaaatgcaacaactttttatattacctattagttttggagttctttatgtttaaaaattcaggtgtaaattttattgccttggataaataaattattgatcttttttaaggcagcagttattaaattggtaatagaagatgctgcttgcttagaattgggaaattcggctgggtgcagtgactcaatgcctgtgatcccagtactttgggaggttgaggcgggcagatcacttgaggtcaggagtttgagattggcctggtcaacatggtgaaatcctgtctctactaaaaatacaaaaattagctgggcatggtggcacatacctgtaatcccagctactcgggaggctgaaacaggagaatcgcttgaacccaggagatggagttggcagtgagccaagattagcctgggcaacagtgagtgagactcggtctcaaacaaaaaccaaattgggaaattcttcttgagttaaaaaagacactttttattatgaatcagattccaaatcattaactatttttgcaaaactggcacaagtggtttttctttttaagtatattaacagggtagctcctgagcctttccctttattggaaactttaactgcagtgttaatatatacactgcaaaagaccaaggatgcagttgaatggaaaattactcagtgtatagaaaggaaaaaaaccagaaatttaaaatagatacagaaaagtacactggtaatatttttatttcctattggagagtgaatccccacagttgctttttgtgacttgattcaaatgaggcactcattattgttaccaaacttgtaaaagcattccatgtattcagtggaggcagaatgtataatattttttccttataatttagcatacaggaaaagtatttattttttaagtagggtatcttaattatgctcatttcttcccctaaaccacattatctatatgattggaccctttagtgaaatcagaaaaataaagtaggcatgaataaatgttcaggacacacacatacactcacacacatcacagtatcagctctttcagtgagtttttattaactagataacacatgtaatacatagtagaatacatttcagaggcagagttcctcggattattttttatggatattagtgttcagcagcttattatttaaaggggtgccaaatatagcatccttctgttgtttattttaaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggccttcgacctcactttgagaaataccttcttcaggttattctttatgtttgtcctgtggttaaatattagagtattcatgataaaacattttgagaaggggtaagcagtgagttattacccacaatttaaagcaaattttgaatgaatctttaagttaggtatctaccttcccaccagccccccaaaaaacctctcagtagtttctttcagtgtacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttacttaaatctgtttttatttttgtcatgtagaatactactgtggtcatcataatgtaatctatttctgtaccttttttttttttttttactttgaagtctttaaataaaatgtataatacccattga

SEQ ID NO: 24279 - DNA, 3285 bp, Homo sapiens
ccgccagccccgccagtccccgcgcagtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtc

SEQ ID NO: 24280 - DNA, 3042 bp, Homo sapiens
agtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgt

SEQ ID NO: 24281 - DNA, 2008 bp, Homo sapiens
tccttagccttttaccctgccttctctttctccccacaataattcccaagaaaatagtcatccaaagggactctttgccctccaagaaactgagttacggcctgatagcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttga

SEQ ID NO: 24282 - DNA, 2284 bp, Homo sapiens
gggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgat

SEQ ID NO: 24283 - DNA, 1127 bp, Homo sapiens
gtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggt

SEQ ID NO: 24284 - DNA, 4256 bp, Homo sapiens
ggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattcttaaatgaatcagtttttcttccctttctcctttccgtctttcctctctctgtccttccccgaaagtctactcgggtgggcaaaaatgaaaagggggaaagtgaattatgggatcggtgttttgaaagagcaatgtttattttcagtgcttttcagtttgtcaaagagtggatctcaaaatcttgcttaaagggtaattgagatgtagcagatttatttacttagtcatggaaagaaaaaaattcagtcaaaagctaaagatttccttttgattgaagacagattggttctgtggccttggaactttcccagacttaatggggaaacatcatttctagattagcatactctttggtttaaatttaatatatacatttaatgttacttagggatacttttatattttgcatatataaagcctcatatataaagccttatttctgatgctcttagatttctgaggagtgagatgattaagttgtattcattagtgtattggtatttcttcacatccagtgaaattggagatatgttgtatgttagaagagcattctttaaattgtgttgctttgaacatgtgtaccttttctagattcagtaatcccttccccccgtcctctggagtatgaaacctttagagtcacaataaaatgtaactaaagaaaa

SEQ ID NO: 24285 - DNA, 3726 bp, Homo sapiens
tcctcccgcctcggccattttccctcctccccatctcctccccttagtcccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcagcttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcaggggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaa

SEQ ID NO: 24286 - DNA, 3600 bp, Homo sapiens
actgtcgctccggacacttcctcctgggccgccgccgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggtgaattcccccgggccgccttctgagtgggatcctcttcttggagcactggatcctgggattccctctgcccccttctcaatccctcctctagggaaggggcctttgaatcgcgggctctcctgatccctgtgaccccgacctactagatttcctctcaggcttcttggaatctcaatcgctgggacctccaacccactacttttctcctttctgatcttctgggagccctggattccgggcctctgacccactatagtgcctttctctccttcccaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgtgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagc

SEQ ID NO: 24287 - DNA, 3321 bp, Homo sapiens
actgtcgctccggacacttcctcctgggccgccgccgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgtgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagc

SEQ ID NO: 24288 - DNA, 2923 bp, Homo sapiens
gttcattcagcatcccctcccacctccgccaggttccggaaaattcgaggtgtccacgctcccggagccactctccctcccaccccagctcccccttccagccaccaaacccacgccggcgccccctccccgtacaattggggcgctggcatcctgcccggctcgcgctggggttgggagggggcaggcaggaagcgagggcctgcggggtctctgcgtttccgggggaaacagccggccctgccctgggagggtcacagtccgcccgctgctgaaggcggctctgagcttttccgtcgccacatccctctcccgcccctcagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgtgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctc

SEQ ID NO: 24289 - DNA, 2502 bp, Homo sapiens
gaggcaagtgtcaggccgatgtgtcgcccgcgaggggccggggtcggggccgccggggccatgcgcgcgggctgggcagggggccggcggggcgcagagcggagccgcctcggagcctgagccgcccggggccggggccggggagccgcgcggggccggccggccggggggaggggagcgatgcggcgccggcgggcggcagtggccgcgggtttctgcgcctccttcctgctgggctccgtcctcaacgtgctcttcgctccgggctcggagcctccgaggccaggccagtcccctgagccttcgccggccccgggtccgggccgtcgcgggggccgcggggagctggcccggcagatccgggcgcgctacgaggaggtgcagcgctattcccgcgggggccccgggcccggggcgggccggccggagcggcggcgcctgatggacctggctccgggcgggcccggcctgccgcgcccccggcccccttgggcccggcccctgtccgacggcgccccaggctggcccccggctcccggcccaggctcccccggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagctaaagcccctgctgctgctgctgcacatgccacagcaggcggtgggggctgcgtggggacaatccatcgtggagtgttctctcagcttaggtctggacaggagacttggcgggagatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttatttttgtaaaaaataaaataaaattagttaataaaatgatgtttcacagcaaactcttccctaa

SEQ ID NO: 24290 - DNA, 3069 bp, Homo sapiens
cggcggcctggccaggcgaggcgggagccgagcaggccggagcgggccgcgcgccggggagggtcgcgccgcgcccgccccctccccgccacgcccggggcgcacgcgcgctcctctggccgcccctccctccgcgcggggacccctggcgggcggcaggaggacatggccagcgacgccgtgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattaacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccgga

SEQ ID NO: 24291 - DNA, 2960 bp, Homo sapiens
aagagggcggggccctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattaacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggatccttgc

SEQ ID NO: 24292 - DNA, 2632 bp, Homo sapiens
gcttttgcgacgcggtgacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctaggtatgtgtctgagattttaagcatctcttatacaaagttattgggacattcttacgtactgattatagcaggtgtactgagtcttgcttttttcccaagtagtattttgaaagtagtgttctgtttacttaaaaagtaaattgtttgctttaattttaaagctgtttaaaatacagactttctattactgttttggtgagttactttatcttctataagtgattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaaaattgccactgaactgtgaatttatggttttttgtttgttttttgtttttgtttttgttttttgagacagagtttcactcttgttacccaggctggagtgcaatggcatgatctcggctcactgcaacctccgcctcccggattcaagcgattctcctgc

SEQ ID NO: 24293 - DNA, 3147 bp, Homo sapiens
tcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatg

SEQ ID NO: 24294 - DNA, 2890 bp, Homo sapiens
ggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacagggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctc

SEQ ID NO: 24295 - DNA, 6121 bp, Homo sapiens
gcttttgcgacgcggtgacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagtactttttgtcctagtgaaggcttaaaaccatgaacattcagagcaaactgtccacttcattgggaataatgggaaaagtttgtattctgctcctgtaaggtcagtagcatcttttatttgaagcatatttatggactgcttactgtgtatagatactgagaataggaagtttttttttttaaagcaacaaaatgttgatgaatgaagaacagcctgttttaattaagatgcaagcaccagtattgtatgtacttttctcttgtttgaggttagcttattttaatttaggacctggcttctcaaaaaggcaaatgaataaaacagaatactagta

SEQ ID NO: 24296 - DNA, 632 bp, Homo sapiens
ggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacagatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagac

SEQ ID NO: 24297 - DNA, 342 bp, Homo sapiens
gggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagacttccgtctgagcaacacactctgcatccttgcttcaccgggaaactactgaagttcctggggaagcaaagtagaatttcgtaagaacaaaatggatggagagaggagaaaacctatggtagctgtgaaggccctgatgccatgtatgtcaaattga

SEQ ID NO: 24298 - DNA, 2379 bp, Homo sapiens
aaaaaattctttaagctcctactggaccataaactaaattttaagtaactagggagagaaatactactgacattaatagaagactacacatgacgaaaagatgaacatggatgaatagtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctattttt

SEQ ID NO: 24299 - DNA, 476 bp, Homo sapiens
acagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagacttccgtctga

SEQ ID NO: 24300 - DNA, 3375 bp, Homo sapiens
ggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagagaagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgtg

SEQ ID NO: 24301 - DNA, 1918 bp, Homo sapiens
attctcctggcagcccccgcccgccccgccagggggagcgtctgcgcccgacgtaggctgcggggcctgggctggcggcgcagggcggtgactcggctcggtggctgccctcccgcgtccccaccccctccccgcccgcccccggcgcggccctgcccgccccctccgccccctcccgcagcgccatgcgcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggaaatctgatgtacctggagtagtaaaaacaggctccacgaaggagctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatgatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaataaacagaaaa

SEQ ID NO: 24302 - DNA, 5088 bp, Homo sapiens
cgcagcgccatgcgcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatgatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaataaacagaaaactttgcttatttcttttgcagcaataagcatgcataataagtcacagccaaatgcttccatttgtaatcaagttatacataattataaccgagggctggcgttttggaatgcaatttgcacagggattggaacatgatttatagttaaaagcctaatatgcagaaatgaattaagatcattttgttgttcattgtgcagtatgtatatagcataatatacacagtgaattataggtctcaggcttacttgatttttggctattttatatttagtgtacacagggctttgaaatattaatttacataaaggccttcatatattattacgtgttatatattacgtgttataaatttattcaataaatatttgcctagaattcccaagacctttataggtgattttgttttctgggctccttaacttcataaatagctagtatcttccagcagtagtaacagtctggataacttcttccatatccctccctctttgtttttttgagacagtgtcactttgtcacccaggctggagtgcaatggtgtggtctcggctcactgcaacctccacctcccgggttcaagtgattctcccgcctcagcttcctgagtagctggaactacaggcgtgtgccaccacacccggctaatttttcgtatttttagtgtagacggggtttcactatgttgcccaggctggtctcgaactcctgaccgcgtgatccaccacctcagcttcccaaagtggtgggattacaggcgtgagccaccgcacccggcctccatatcccccttttaaaattctgtagtgtatggtaagtcatatcagatatcagacctaatttaaatttcattttagctttacaagtccaaaaacacagaatttatatattcagatactctagcactaattttagtcttaaaatattcccacgatattctgtacacaaaatgttctttttgttacaagagctgagttgcatatactgtagataaatcatattatttttgccaatttcacaaattcctctggcccatcatgtcagtcattattgagtatatgcacacattgctacttatttgattatgtatcttttaaattgattcagtgcatagaaaactatctcttacaaactttaagtgctctgatatgacttcccccccaaattttattatgaacatttttaaaaacagaaaaattgaaaaactgtttggtaagcacatgtatatctaccatttagattcagcagttgttaatgttttgtcatttgttttctctatacctatatatgtatagatacagctagttatgcatatatatgcatatatgtgtttgtttgtgtatgtatatatgcttttttccccctgaaccatttggatgttacagacatacttatcaccgtgaaaatacttcaagtatctcctacagataatgacattctcctaaaaatccgtaataccattgtaaaagtaataattccccaatatcatctaatcaagccatatttaaatttctgaagttaactccaaatttctttatagctgattatttcaaactaggatccaattaaagtttacatatgacacttggttataactctttagttggatataacattattattattttgataaaatatggaacaaatcaattctattaataagtggtcacatttgttttgggcttaaattactttttaaagatactggattttcctaagatttctgatttacactgatatttttttttgtcattcttaattgcatcacacaatagatgtaaatgaagatgtagtcacctcagataaaattggtatcgtgtatgataatattgtatcatttatatttgccttatgttaactttaagaaattgatttttttgtattaatcattttcccattgcaacagagctatattttttctattttaagaatcatattttaggattatttttggcaaatacagtgagcacttatgtaaccagatgataatgaactcaaatgtcatgatagcttgcataaatggtgactctagtagatttgactcaagcacttctagaatcatgcactgaattcaaaagaaaaatcttgctgctttttgtccagggcttgttctattcaacttctaatttgaaagctgtacaaagtaatagaagttccatttaaatatgagttcaaaactgtatttactttttatgtggccctctctttaggggattctaattttacttagggtctctaagtgcagcataatgttcctgatgttaacagaagactgtatttttaaagttacaaatttgtatatggaattaagtaatggcgctatatacgctgttgtggggaggggggaagaaaaggaggaaccaattaaataggaccttttaaaaattgttaattttgtaaactttgcttctcttataagttattgtgattcattttagttactgtgttttattttgaaaatatttaaatattgcacttctataaatagtatgataaatgcacagacaattgcagtaaattcttttttaagctaggatatttgaaatgacaacctttggttaagtgtgtcaaggttgcaacagaattttcacaatttttttgttgtttgcaaattgttactaatattgaagaggtaagggaggcaatgcaaatgatttttaatctttttttattatcttttcagcagtttatattttttgtgactttatgcaaccatatttttactttgtcttgacaactgaaagatgtataaggttttttgccagaaatgtactgtatacatagttttaagtataacagattttactgatatgtaaaaattttgccattaaaataaatgatttctcactgagaggaacttttctaccaggttggggcatatgggagcttaatatatcatatctaatttaaaataatttcactgaaataaactccattgcttttacctaatttttttcttgagatgcttttgtagtttttcagagttttagatgattttatacaaaatcctctgcctagcactgctctttttgatgttgtagtgacaccatttacattgaattaatgcttggtagcctggggctagatgtggaactccatggatctgtgttctgactggcacctttggaatgaaagaaaagtgtgtgctgtccaaattttttccccttaattctttccctcatcttctcacccataatagaaattttatttccattgtgagttctgacaagaatgaaattccacatacaacataactgtaaattgttggtaggtagaagttaatatttgtggttcatgtatattttgaccagagtatatttaagtatataatttcagcttccttgatttagaaatatgatataataaagaaaaactccatttatcatctgtta

SEQ ID NO: 24303 - DNA, 9347 bp, Homo sapiens
ggtaggcggcggcggcggcggctacgcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagattggagaacatcaattaacaggccataaagtggcagttaaaatcttaaatagacagaagattcgcagtttagatgttgttggaaaaataaaacgagaaattcaaaatctaaaactctttcgtcatcctcatattatcaaactataccaggtgatcagcactccaacagatttttttatggtaatggaatatgtgtctggaggtgaattatttgactacatctgtaagcatggacgggttgaagagatggaagccaggcggctctttcagcagattctgtctgctgtggattactgtcataggcatatggttgttcatcgagacctgaaaccagagaatgtcctgttggatgcacacatgaatgccaagatagccgatttcggattatctaatatgatgtcagatggtgaatttctgagaactagttgcggatctccaaattatgcagcacctgaagtcatctcaggcagattgtatgcaggtcctgaagttgatatctggagctgtggtgttatcttgtatgctcttctttgtggcaccctcccatttgatgatgagcatgtacctacgttatttaagaagatccgagggggtgtcttttatatcccagaatatctcaatcgttctgtcgccactctcctgatgcatatgctgcaggttgacccactgaaacgagcaactatcaaagacataagagagcatgaatggtttaaacaagatttgcccagttacttatttcctgaagacccttcctatgatgctaacgtcattgatgatgaggctgtgaaagaagtgtgtgaaaaatttgaatgtacagaatcagaagtaatgaacagtttatatagtggtgaccctcaagaccagcttgcagtggcttatcatcttatcattgacaatcggagaataatgaaccaagccagtgagttctacctcgcctctagtcctccatctggttcttttatggatgatagtgccatgcatattcccccaggcctgaaacctcatccagaaaggatgccacctcttatagcagacagccccaaagcaagatgtccattggatgcactgaatacgactaagcccaaatctttagctgtgaaaaaagccaagtggcatcttggaatccgaagtcagagcaaaccgtatgacattatggctgaagtttaccgagctatgaagcagctggattttgaatggaaggtagtgaatgcataccatcttcgtgtaagaagaaaaaatccagtgactggcaattacgtgaaaatgagcttacaactttacctggttgataacaggagctatcttttggactttaaaagcattgatgatgaagtagtggagcagagatctggttcctcaacacctcagcgttcctgttctgctgctggcttacacagaccaagatcaagttttgattccacaactgcagagagccattcactttctggctctctcactggctctttgaccggaagcacattgtcttcagtttcacctcgcctgggcagtcacaccatggatttttttgaaatgtgtgccagtctgattactactttagcccgttgatctgtctctagtttctttctgttattgcactatgaaaatcagttatattctttaaatttttatcttacttttggataatatccactgcaatactaattgagaaacatgaattatttccaggggcacacaatgctattgaaattactgaaaacaaaatatctgacatcttatttacttgtagaaatctgtaattctattgtgcctatgataaattcacataggcaatatctttaataggttaatatcaatgaagatttttaattacaataatgagttcactacagacgattaacacaccacactggcgaaccatctcaatgtaagggtggtttggcaacacctccttgctttgctgtttggtgtaggtaaatctagtttacttcctaaatttcagtaggctttatgctgtgtttatgcccccaatttattttaacaaaagaagattaaaaagtaaaagaaccacgagtaagatattatttaaatgttgaaatcttaaaaacctgcctccaagatttcagaagccaagtttttctaacagtatttgtacaaatactgcctagtgtattcaacagaaggactgtggtcatgtaacaggtaaccacaattttcaggtttcttaaaaacagctgtaactaactcaggatttttatcttgagatttccctgaataatatatttatcttaagagccttcaagtttcaaattaatattggaacatctggaattgcaacaacttttgtcttttacataaacttacgtcatttaaaaaatgtcttcaaaatctacctttctcaaattctttttgcctctatttatttttgcatttcaccaacagtgataaaatagttaaatgaaacaaagcaaagtatcaacagtcccttaaatgagaatccttatctttgatctttattttctgtgttaggtgttagggtcctggtgcagctcataatgctaattcttcattggaagccactcccttcacctcacctcacctagtcactattgtctttgttcattgtttgatcctgagtggttgattgatatagctttgaatcttttctagtccaagtttgaaaacactgttctggccctaagggctggctatgacctttactgttgaacctgatagggcagggaagctttgaacatcaagaaaaaatttttatcttaaataaataaatatatatattcacacaccagtgcttttaagcaaaaaccagtttttttgtttgtttgttttgctttgtgcaggttttctttaagattaaaaaaacacaaactatagcagggtagataatagtttattgattatattttgttttagtaaaagtatttaattttaaattctgtgtaatttatctaatttgtatttattcatttgttatttttatgttgtaattaacacttatttacctggattaccctaaaaaaattaagctcttgaaaacaaaaaaatgacattaccttgacaggcttctctttgccaaaagtaatgtatgttctgccaagaagcaaatgagaatgttagactaagtttctcctgtgttagtggaaaacaagtgtgtctatctttaaatattctttgaatcaggagtttgcgttgtgtcacatcatatggctttgcagatcttttaaaaactgatgttaaataacttataagtccaacttcttaatatcaagataaatgaatagttcaccaatttgggaaggagggcgggttgcaatttgagatagtttaaggtttaattattgaaagactgccatcttgtggcaccaaaaggtaatttttacatgattatttgtatagtgataagcagtcctgctgtgttagcctggtccattatagatatggcatagttttgggttctctaaatgggtccatacctcttttgggaaaaaacagggccacctcataatatttgcctgattatgaatggaattaccttagaaataaggaactaatcagattacttaaccccaatgacaaaatccacaaaaattttgaaggcagagaaacagaaggaatccagtgatgttttagctccattagtctaataggtcagatattaaaaaattgttcatatcaaaattaccttatatggattattgccatgttttttgagagttaattatttactgttttctaattcttgccagtatttatgaacagctgtagcttgatatttacctactgaattttaggagaactaatggtcacagtttgggttcttttatgtgtatgtttttaaaacagctattttgtgaatctaggtggttggtttttagaagatttcaggagatgcagtccagcacaattagagctggaacattgttacagcaggctttttgttgctcatgggcagatagagggaaagaatcagttgttagccccaaatttccacatttcagtgttgtaaactctgaatgtgataggtagatgtgggctaagaataatttcctccagtgaagacacgggagaagagcttctattatgaggttatagataaggccttagttatatcatggaaatggactccatgtagttctagaactgcatttcccaaagtatatcctgtgagatgctccacagaaaaaatgattgcatggactaagtttgaaaaatgttgcatgctactcttcccctcgaagatgacagtggatgtcagcattaaagactttgacaggtctttctgtgaaaaaaagaaagccacataactttgttgaactttgcccaaattaatttttcattttaaaaaacttaatagcccatgaaaagcaaatttgggaaatacattttttaggaaaatactgtcccagaatgccataattagggtagttaataattaacacttccatttctcttactggttgttgggagaatctgattgaaaattagaattactttgttttaacttgcagacatgttcatcgtgagtgaatgctggattaaatagaattttctgtgtctgcaacttgtttcatgacaccttggttttcttaatcatcttgtattattatttgagtgcaacattattcttatgcatgggtgactgaaaaacctgaaacaagattacttgttaaaaaaaagtctaagagactaatgactcatgcttatggctcagtgggtaatgaatcagtgtcactgattcttacttttaaaatgtgtagtcagtgaacattttctaaatacttttctttgggataccatatgaagatctaattccttatgtttcagtgtaggaacagctaccttctcaaatagaatatgcagggagggaagtaggcaaaccatttacaagttgggtttttgttttgattaacctgttaagagacacttttgtaatctctagtgtttacattcctttatactagctatctataaagagaatccagaaggctaaattaatcagaaataattatatttctatgtcagggtattggctatatgtagcatgaacaattctccattttctgcaaatgggtttttcaggacagttttataattctgagtttgctttttcttattccctagacagtttgtactcagggaatacaaattgatttttactgttaaatgagacatagtttagaaaaaatcataagcaactattgtagatttttgatctgtttggatttatctgtagcattgaataatgtgcagtgtactgagttaatgtaggcacctcactttggatttataaaatgtaaaaacctggaacatgcctgccacagacaccactttgtctattcaccgggtactaatttacatcctattaatggttgtaaaagctgagtgtctaaatgctagacatgttcacaattttgtctgtttttgtttatttgtttttaagacccaaaccttttcaatcttgcatttatttacttggttctcctgtgtcaccctgtggctttttaaatagggaatgtaatttattttaatagtagttctcaaagactctattaaaaactctggacgagggatatgtgcaatctgttggtaagtcacatcctatgtttggcctcatttttataactcctaaaatgagaaaggtagattttaacacttctaaggtacctttgagctttaaagttcttttctgcttttccatatgatttgtgttagtgttcactttttatatatttagagtttttatatgagtgtgaatgtttctgttttgatttggtgaggcatgtcagaggtatatacttgaatatttttctaaatacagctgctggaggaatgcaaatggcaaaaatcatccagaaaaccaaacacggtgaaacatcacatccatttggcatgaagcaaagcattacaaatttggagtgatgaaagtgttccatatattttttatagtgatttttcgatctagagacccttcatattgtttacttactattacgataactttgagaggtaaccagagaaagcatttttgccatttccagatgaggaagcaggaccagaaagctcttcataaagctttaacaccatacaagtatccagcagtgatcaattgctctttataggaaaccacctttcctctggggaagaacagtctgaattaataaaacatcagagtggttgagtagtaaaaataaacacagatgtattgctttcaagtcttagagtgacataaagtagtcttaaataaatagttcttagtttattttaagcagttgattgtactaacgagatgtaattatctgaagtatttatgattagcatattggtttttataagtatttctgagttattgagggtgcttaaaaatgctgaagaaactttaaaacatgattcttcttataattttatgtgattcttatagcacaatcatttttgaaaaaggaaaactaggctgggtgtagtggctcatgcctataatcccagcactttgggaggccaaagtgggtggatcacccgagttcaggagttcgagaccagtctggccaacatggtgaaacctcgtctctactaaaaataccaaaattatccggtgtggtgacaggctgcttgtaatcccagctactcgggaggctgaggcacgggaatctcttgaacctgggaggcagagattgcaataagccaagatcatgccactgcatgccagcctgggtgacagcacaagactgtctcaaaaaaaaacaaaaaaaggaaaaagaaaactagccccagtccctgtctaaattgttatagtttttgactattatctgaattagtcttatccaaatttcatatgcagattgatttttcattttgtatgtatattacatgatataactattttcatagaatatatttctaatttacaaacactgaattattagcttgatagagtttctcccaaaccttataaaactttgaaatgtacttatgtttgagctttaaaaattataaaaacttcatttaaacaagttgctggcatcattactagcctttccacctataattatgatgcatttgatgccactgaacagtaatagcacaaagaacaggtcacacagtctagactggattgagttttaattaaacttcttcatccatagcctgataagaatcaggctgggtctagaagagttatcagactgtaggcctgtattaattttgcaagctaatgttaatgtttactgccagccttgcatagcaatgccagtttgcagttgtgactatgatgtgacttttggtaaaaatggtttatatctaaagtagtttagattttatggaagtggctcttgattgtttggacaagcagggtaggtaaatttcaattacgtttgaagtgtaattaaatcctagaatagagcactctccagaaaaaaaaatgaaaaaagaatttggagaatatcctggcatgaaaacttttttgaataatacgtagaattttgacaaggttcatacagtgcatacagtgtgaccttttctgaggtgggcagggagggttgctacgttgtgttgatttaaaatttcaaggaggaacaaaaacattctagccaaggagaattgcattgttatttttttttctactaatttaaacgtgcatttttcacagttacacatttaagttttgctaccaaaaatggccatttttctagacagataacattttcctaaagtggaagagagatccactgttctaaaaaaaaaaaaaaaaaaaaacactaaattgtgccttctcccttaaattataagaagagtaatagtaaaaacttgtttaaactatattttctttttttctaatccctctcagttctccttagatctgcctcctacaaatgatcatgttgtttgcatctgcctgattgagttcccttggtcaaacctctccctatcactatcagaagttgttcactaaatgtattttcctatttctttcatgttgattgactttataagtcaccttggtaaacataacatttggctaccttctcatgctttataaatgaatttgatgaatggcagtttttatattttaaccctttaaaaagtttgtcaaggaaacaactcagagctaagaacaaaatctaacttggaatcagtttcttcctttggctgctgaagcagcagcaagtcacgtaacctcatttagttttttgatttacaaaatgtggataataacctacctcacagatgtgtgtgagcaactgtttgaaagcccttgtttaaatacagggtttatatccccacattcaatgtaaattcctttttttaaaaaaaataagtatctttgatactgataggatgagtatcttgatttttaggtaagatcacagtttcacaaattgtggtgttgttaggtgacatttaatatttcttgagacctcaagtattcaaatatcaaacttgtcctgtgttgtaacaaatattcagaatctcttaaaatgttggctgaagctgccttaatgtaccaaaatacagctctcaagactgttcacaaatatctgtggttgtacaatgttttgaacatttaatgtaaagttgttgtagaactgtgaactctaaggatagtatctttattgttttaggaagaatggttgtgttctttgtcatgtatgcttaaatatacagtggattttgaatgcaacaaataaaactgaaaacagccatttggttgtgtcatgacaatcataatataggatataatatttactttttttcaaaaacatcctgcattcattcattcttagcatacctttgaaaaagaaaaaaaaatccataggttgatacattgacccattgaagtacttcattacgtatttattgaaaattttttttaattgttgaaattgggaccactttttataattggtttcaagaaaaaaaaatgaacagacttccagtgcttttctgttcaaataaactccgattcaaatttcagttttgtttgttatatactttttgtgagtgttaaatgatatgggaaggatttgtctttcattaaccatatggaaaagatgtcttcctgaattacatagcatttcatagttacagattcttcctaattaatgtttgcaccatatgaaactcataggtaacaaacacaaaggagaaaagcagcctgtctgattgcttataagcttttttcacaaaatcaaattaaaagtctctgattcatttgaaagcta

SEQ ID NO: 24304 - DNA, 1738 bp, Homo sapiens
ggatgtggggcggggcctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcagtcctgcccctgtggatttgcctttatgattattactgtcttggctacaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacg

SEQ ID NO: 24305 - DNA, 2071 bp, Homo sapiens
acagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcaccggatgtggggcggggcctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctc

SEQ ID NO: 24306 - DNA, 3282 bp, Homo sapiens
gagctggtttattctgcggccgaggattacatttatgcacgaacgggcttactggttccagattccccacttgggcacaggcataggaggcttgttttccaaattgctggttttaattgcacctgcctttcagattacctctgggaatctgtgggaggagccgagagggtggaaaatgtttcttagctttgcaaaaggaagaaaactttgtcacccagcgggagacctcagccacgagtaacccggggagacaccagaaccgggacgggctttgactgatttgcctacgagggttccgtaggaaaggacgcttgaattcggcgcttcggcggcggcggcggccgcgcgagttccctgctcaccctccctctccgcggaagtccccacgaggtggcttcagggtgtaacagagcgcgcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccggacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgttttttttttgttttgggtttttttttttcagattgaaaaattaaaatagatccta

SEQ ID NO: 24307 - DNA, 2645 bp, Homo sapiens
gctgtggccggaggtgcagccccgtcaggacggctccactccctggcgcctcacagactctggggctgcggtgaggtcgccctgaagaccccctggtgaggacgcttgaacccgggctgtcacctgagcacaggctgccactctgagcttttggggcgccctgtgcctgtcgggctgatgctcctctggctcccggccacctggggctgacaccggttctgtgggtcctgatatgttcacctgtcgccactcctgtggccacagctacccatgaagcgctttgggagcctcaggagcaacaagaaacacaaggaccaaaatcgaagcacggagaggcgccagtcggagcctcatggccttttcgcctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgttttttttttgttttgggttttttttttt

SEQ ID NO: 24308 - DNA, 2326 bp, Homo sapiens
gccacagtgtcgcacacttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggcagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggcttcttcagccctcccaaattgcccttgccctacctgtgctcccagaagccctcgggcatgcccagtgcaccatgggatgatgaaattaaggagaacagctgagtcaagcttggaggtccctgaaccagaggcactaggattaccccagggccatctgtgctccatgcccgcccatccccttgccgcctgactgggtcggatggccccagtgggtttagtcagggcttctggattcctcggtttctgggctacctatggcttcagccttcagctcctgggagtcccagctgttgttcccagcaacgtcgccactgccctcctactctccaggctttgtcatttcaaggctgctgaaatgctgcatttcaggggccaccatggagcagccgttatttatagaactgcctgttggaggtggggagtcctccctccattcttgtccagaaaactccttagctctcgcagtgagccatgttcttagtctccagggatggatggccttgtatatggacccctgagaatgagcaattgagaaaacaaaacaaaaggaacaatccatgaacttagattttattggtttcactcaaaatgctgcagtcatttgacctgaacttgtggcaagagacttgtgctttctaaattcaaagactagaaggaaaatggataaaaatcacaagtgccgtttctcttgc

SEQ ID NO: 24309 - DNA, 1193 bp, Homo sapiens
acacttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctgagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgatt

SEQ ID NO: 24310 - DNA, 2301 bp, Homo sapiens
agttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggcagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggcttcttcagccctcccaaattgcccttgccctacctgtgctcccagaagccctcgggcatgcccagtgcaccatgggatgatgaaattaaggagaacagctgagtcaagcttggaggtccctgaaccagaggcactaggattaccccagggccatctgtgctccatgcccgcccatccccttgccgcctgactgggtcggatggccccagtgggtttagtcagggcttctggattcctcggtttctgggctacctatggcttcagccttcagctcctgggagtcccagctgttgttcccagcaacgtcgccactgccctcctactctccaggctttgtcatttcaaggctgctgaaatgctgcatttcaggggccaccatggagcagccgttatttatagaactgcctgttggaggtggggagtcctccctccattcttgtccagaaaactccttagctctcgcagtgagccatgttcttagtctccagggatggatggccttgtatatggacccctgagaatgagcaattgagaaaacaaaacaaaaggaacaatccatgaacttagattttattggtttcactcaaaatgctgcagtcatttgacctgaacttgtggcaagagacttgtgctttctaaattcaaagactagaaggaaaatggataaaaatcacaagtgccgtttctcttgc

SEQ ID NO: 24311 - DNA, 2222 bp, Homo sapiens
ctgctcaatgaccatgttcccacatgctccaagccacatcccctcaaaaagggtccctctagcttgtcctcagtgacccaggaggcagctgaggaccaagtacccagattatccggtgcgccccttccctcccagcaacccccagccttcagggctgtagcagctgagcaaatgggggcccctccctctcattgcctgacacccaatcagagagaaaccgatcctggcagggcagggtgcccggggccgggcccagaatagtgcagcccagccacagtgtcgcacacttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggcagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggtaggctctgccctgggccatgacaccagcctcttagtcttcctgatttcctggatctcagattgggacaccctgaggatgggagtggccaagctcaaagctgagcagccctgtgaaaactgcaagtgtaaggactcacaggtccccactttgtcccattttcagctgaggtcatggagactgtcctagaagggagggacaaagccccggctaaaagctaaggctgcgatgtgacttcagacactctgggaagatttacttgttccctcacaattcaatttccacctgctggaaatccccttagaaggaagcaagctata

SEQ ID NO: 24312 - DNA, 1784 bp, Homo sapiens
acttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtccccggtccaggccagctgctgagtccaccgggctggaggccacattccccaagaccacacccttggctcaaggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggcagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggcttcttcagccctcccaaattgcccttgccctacctgtgctcccagaagccctcgggcatgcccagtgcaccatgggatgatgaaattaaggagaacagctgagtcaagcttggaggtccctgaaccagaggcactaggattaccccagggccatctgtgctccatgcccgcccatccccttgccgcctgactgggtcggatggccccagtg

SEQ ID NO: 24313 - DNA, 2671 bp, Homo sapiens
gatcttgggctgaggttcccgggcgggcgggcgcggagagacgcgggaagcaggggctgggcgggggtcgcggcgccgcagctagcgcagccagcccgagggccgccgccgccgccgcccagcgcgctccggggccgccggccgcagccagcacccgccgcgccgcagctccgggaccggccccggccgccgccgccgcgatgggcaacgccgccgccgccaagaagggcagcgagcaggagagcgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgttt

SEQ ID NO: 24314 - DNA, 2472 bp, Homo sapiens
ggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgttt

SEQ ID NO: 24315 - DNA, 1457 bp, Homo sapiens
acagacagcggcagagatcttgggctgaggttcccgggcgggcgggcgcggagagacgcgggaagcagccgccgccgccgcgatgggcaacgccgccgccgccaagaagggcagcgagcaggagagcgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtca

SEQ ID NO: 24316 - DNA, 1524 bp, Homo sapiens
ctctgcaaaccttggctagcttggagcaggtacctttaaaagcttctgtggcaaccagctcctcctccctggtcccctgaggccatcccaaggaagctgacttagaggctctgcgttttcctggtttctcagcaaaaggaagattccagggagagcccaagggggctggggatggatctgggatcaggcagcagccagggtggggacttggagaccaccttccagctgtggctgcagctgctcctctgggcccacctggctgtacgtttcctgggctacctgcaccgcaccttccgggggcctaagccacagccagcaccctgagcctccctggccagggggcagaaggccgccagatcaccccatcccacccaccctttattctaccctttcctggaagagacaggaagcagagtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgaggtccggatgtggggacacagccctggaagaaacagaccgttccctgctcacccatcctattccctggggagccctgcttgttgtcagaataatctagaagttccttaagtcaggccaggtggtgaagctggacgcgccggccacactgaggccaacacctcaagcccccttgctgtccagccccaaccccgcggttccagaatcccatgggcttccaaaatcccgagcctcacgggaacatcttggccacagaacacaaaccgccctgccagacgaccctccttttcgctcctcatcccagttagtgtgagttttcgcaaattccaaggcagaaaaacgaatgtatttggttcctgttcccaggtgctgtccatagcctcaccca

SEQ ID NO: 24317 - DNA, 1278 bp, Homo sapiens
attctgctgtttgctccttgccaggttcaacatgggattgtcacgcaaatcatcagatgcatctgcttgctcctcttcagaaatatctgattttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaac

SEQ ID NO: 24318 - DNA, 1914 bp, Homo sapiens
ccattttgagttgttctagtggtatatgaaggaggctgggataactagcttgaaagaaattcagtctagttatagacatctttggcattaatctgatgtttactagtgatatctcatgctaggcagttatgctttgcttctaggggcttctctttttaaaacaaaagaaagctcttttcgttttctgtgtgctgcatgctccagtgtgtgtgtttacaccatcggttcttctccctctagagattagcataactccctttgctgttggattgttattttgagcaatatgttttggaaaggttggttttcatcatgagtgcacgcaaatcatcagatgcatctgcttgctcctcttcagaaatatctgattcctttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagcagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaattttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtcatgaaagtggaatttttgccattaaaaggctctgtattatgtgaagttagattgtattaaccatttcccaataaatcatctgtttcaaaactcaaa

SEQ ID NO: 24319 - DNA, 1380 bp, Homo sapiens
atgctgctactatctagttctataagcttatataaagacagaaatgaagcaagactgatttcttcacagaataatgccggacttgaagattttgaaaggaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatattt

SEQ ID NO: 24320 - DNA, 4283 bp, Homo sapiens
attctgctgtttgctccttgccaggttcaacatgggattgtcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatgg

SEQ ID NO: 24321 - DNA, 869 bp, Homo sapiens
aatatcagtgaggtccacagctagcagtaagagctggtgtaattgaaagacgtttaggtgcaatcattctgctgtttgctccttgccaggttcaacatgggattgttgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagaacttttgatatgaacaaaacaaaactttgagaaaaattaacag

SEQ ID NO: 24322 - DNA, 4481 bp, Homo sapiens
acatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaatgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 24323 - DNA, 1905 bp, Homo sapiens
gttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaattttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtcatgaaagtggaatttttgccattaaaaggctctgtattatgtgaagttagattgtattaaccatttcccaataaatcatctgtttcaaaactcaaattcaaactagaatgtgtctctattcacattgcaaaaatattattgtctctctggttagtggctaaaagccaaattggaaactaactagttttttaaattttttaaattgtgcaaattattaaaaatccaatttggtcttata

SEQ ID NO: 24324 - DNA, 4513 bp, Homo sapiens
gtctgcccgccgccgccactgctgctgccaccgccgtcgccgccgccgccgccgccgccgctgctgctgccggtgctaaggagttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 24325 - DNA, 4292 bp, Homo sapiens
attctgctgtttgctccttgccaggttcaacatgggattgtcacgcaaatcatcagatgcatctgcttgctcctcttcagaaatatctgattcctttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatgg

SEQ ID NO: 24326 - DNA, 4200 bp, Homo sapiens
gttattttgagcaatatgttttggaaaggttggttttcatcatgagtgcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 24327 - DNA, 730 bp, Homo sapiens
gtgtttacaccatcggttcttctccctctagagattagcataactccctttgctgttggattgttattttgagcaatatgttttggaaaggttggttttcatcatgagtgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaag

SEQ ID NO: 24328 - DNA, 686 bp, Homo sapiens
accatcggttcttctccctctagagattagcataactccctttgctgttggattgttattttgagcaatatgttttggaaaggttggttttcatcatgagtgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaata

SEQ ID NO: 24329 - DNA, 662 bp, Homo sapiens
gctccttgccaggttcaacatgggattgtcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataagg

SEQ ID NO: 24330 - DNA, 648 bp, Homo sapiens
agtgaggtccacagctagcagtaagagctggtgtaattgaaagacgtttaggtgcaatcattctgctgtttgctccttgccaggttcaacatgggattgtcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccag

SEQ ID NO: 24331 - DNA, 638 bp, Homo sapiens
agcacacagcattttaatatcagtgaggtccacagctagcagtaagagctggtgtaattgaaagacgtttaggtgcaatcattctgctgtttgctccttgccaggttcaacatgggattgtcacgcaaatcatcagatgcatctgcttgctcctcttcagaaatatctgattcctttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaa

SEQ ID NO: 24332 - DNA, 944 bp, Homo sapiens
acattttctccctgccattttgagttgttctagtggtatatgaaggaggctgggataactagcttgaaagaaattcagtctagttatagacatctttggcattaatctgatgtttactagtgatatctcatgctaggcagttatgctttgcttctaggggcttctctttttaaaacaaaagaaagctcttttcgttttctgtgtgctgcatgctccagtgtgtgtgtttacaccatcggttcttctccctctagagattagcataactccctttgctgttggattgttattttgagcaatatgttttggaaaggttggttttcatcatgagtgcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactcca

SEQ ID NO: 24333 - DNA, 1571 bp, Homo sapiens
cgagacccccgcccctgccgccgccaccgccatgggcaacgcccccgccaagaaggacaccgagcaggaggagagcgtgaacgagttcctagccaaagccagaggagatttcctctacagatggggaaaccccgctcaaaacaccgccagctcggatcagttcgaacggctcaggacgctgggcatgggctccttcgggcgggtgatgctggtgaggcaccaggagaccggcggccactacgccatgaagatcctcaacaagcagaaggtggtgaagatgaagcaggtcgagcacatactgaacgagaagcgcatcctgcaggcgatcgactttccgttcctcgtcaagctccagttctcctttaaggacaactcctacctgtacctggtgatggagtacgtgccgggtggggagatgttctcccgcctacagcgcgtcggaaggtttagcgagccccatgcctgtttctatgccgcccaggtcgtcctggccgtccagtacctacactcgctcgacctcatccaccgcgacctgaagcccgagaatctcctcatcgaccagcagggctacctgcaggtgacggacttcggtttcgccaagcgcgtgaagggccgcacttggaccttgtgcgggaccccagagtacctggcccccgagatcatcctgagcaaaggctacaacaaggccgtggactggtgggccctaggggtgctcatctatgagatggccgtgggcttcccacccttctacgccgaccagcccatccagatctacgagaagatcgtctctgggagggtgcggtttccctccaaactcagctctgacctcaagcatctgctgcggagcctgctgcaggtggacctcaccaagcgcttcggaaacctcaggaacggggttggcgacatcaagaaccacaagtggttcgccacaaccagctggatcgccatctatgagaagaaggtggaagctcccttcatcccgaagtacacaggccctggggatgccagtaactttgacgactacgaggaggaagagctccggatctccatcaatgagaagtgtgccaaggagttttctgagttttaggggtgtgcttgtgcccctgtgggttttctttcctttttgtttttggtggtttgggggatgggagggttggattgaacagccagagggccccagagttccttgtatctaatttcatcctcaccccaccctccagggttgggggagcaggaagcccagatatttggaggaacagaaacaccagctgctccctcacccccccccatgccttcctggtccctctgtgcttctctctttctcctcccacagggtcccccttgccccagcccccttctgcctgttttaaacgagtttctcagctctattcaggccaggtcttgctgttgtatcaagggacacggtgtggaaagaggggctcaaacttaactccagccctgaacaggcaccacttactaagagaggatgaatgaaaagcacacctaccctttggcgtaatcctgcctgggaaggagagaggtttagtgccatgttcagtgggctgtttgct

SEQ ID NO: 24334 - DNA, 3644 bp, Homo sapiens
agggagggggtggaaaggagggagaaaaggcagaggcgtcaagggaggccggagggagagtggggtggacagaggagcggagggacgagagggaagcgcacgatagctgcgcggagagagagcgaagagcaggcggaggaacaaaggcgacccaagacacccagagagggacagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattctt

SEQ ID NO: 24335 - DNA, 3617 bp, Homo sapiens
gattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattctt

SEQ ID NO: 24336 - DNA, 3648 bp, Homo sapiens
gattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccaggtgagtggggtcggccgggggctcaggcgagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattctt

SEQ ID NO: 24337 - DNA, 3693 bp, Homo sapiens
atcgcagagtggagcggggctgggagcaaagcgctgagggagctcggtacgccgccgcctcgcacccgcagcctcgcgcccgccgccgcccgtccccagttgacttttgtgccctggtaattctgtatcctgtttaccgtttacctacttcccacgtcatcatgatttcttttgagggagaactgaatgaaattcccttaagggcctgacttcagcacccgtctctgcagagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatt

SEQ ID NO: 24338 - DNA, 628 bp, Homo sapiens
ctgtgatgtgggaggcccttcgcatgcagggtaaatccgcagggcccgtgtgggtgaaggccacatttaagggaatcaaaggatgctcagtaaggaatctggaatgaaaaagtggcatgttgggtagcccgggtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagaaaaatttgccgggtgtggtggcacatgcctgtaatcccagctacttgggaggctgaagcaggagaatcgcttgaacccgggagatggaggttgcagtgagccaagatcacaccattgcactccagcatggacaacagagtgagattccgtctc

SEQ ID NO: 24339 - DNA, 2007 bp, Homo sapiens
gcgggcggcgttgggggtgcagcagctgcgcgcggcgcgggggcgggcgtggagggcggcgccgctgcagtgcggggacccgctcgctcgctcgccagccgtccccgcgccccgcgtccccgcgcagccgcctcctggcctcgggcgccgcgcatccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggcc

SEQ ID NO: 24340 - DNA, 1917 bp, Homo sapiens
gtgagggccaagcaggaacaggggtcacggggcaaggagcacgtggcagcgcaggaaacaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgc

SEQ ID NO: 24341 - DNA, 2553 bp, Homo sapiens
agtttctgccgccgccaccctggcaggatggggcaacggtgtgcggtaggaggatgaggttgattccctttcctgcagggctgggcttgtgggttaggaccgtcaccaagaggctcctcctaggcctccgtgacctctggatccccaagaaaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagta

SEQ ID NO: 24342 - DNA, 651 bp, Homo sapiens
gtgggagcggggcccggggtgctcaccgggcgtggcctgcgccagggcggcggcgcagctgcagctctcgcggcgcacggcggcgaaggggtcgagcagggagcagcgcagcgcgcgcagagcgtcgtccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttataca

SEQ ID NO: 24343 - DNA, 1006 bp, Homo sapiens
ctctggccgctaaggcagagtgagaccccagggaacgggcgtgcttgctgggtaccgggtgtcctgcagaggcagggatgtgatcccctaggtgaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggag

SEQ ID NO: 24344 - DNA, 346 bp, Homo sapiens
ggatccccaagaaaggtgggaaagaatttaggagggttccgatttcccactgggcatcggggtgaagctggtgcgcctaagcgctgggagtcacctggggaagcggggctgggcccacctggccaccctctctggccgctaaggcagagaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaa

SEQ ID NO: 24345 - DNA, 2533 bp, Homo sapiens
gtgggagcggggcccggggtgctcaccgggcgtggcctgcgccagggcggcggcgcagctgcagctctcgcggcgcacggcggcgaaggggtcgagcagggagcagcgcagcgcgcgcagagcgtcgtccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtac

SEQ ID NO: 24346 - DNA, 2494 bp, Homo sapiens
ctctggccgctaaggcagagtgagaccccagggaacgggcgtgcttgctgggtaccgggtgtcctgcagaggcagggatgtgatcccctaggtgaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtac

SEQ ID NO: 24347 - DNA, 6471 bp, Homo sapiens
agctcgcctgcccgtcggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattacaggcatgcgccaccatgccgggcgaattttgtatttttaatagagacagggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaaaaaaaaaaaaaaaaaaaaggacaagaactgtcactaacctcatggaggggtttgcgtaaaaccatttagcccaccttgagcaaagggtagattccgtgttgtttttttaagctcactgtaataaaataaatctaattcagcattattgtgctacctcaaaggtaaaaaatgttttaaggtcttcttttggtcctgagttctatatacagtgtttgaaatgtccttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatcatgtctga

SEQ ID NO: 24348 - DNA, 3318 bp, Homo sapiens
tccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattacaggcatgcgccaccatgccgggcgaattttgtatttttaatagagacagggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaa

SEQ ID NO: 24349 - DNA, 1849 bp, Homo sapiens
agtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtc

SEQ ID NO: 24350 - DNA, 3745 bp, Homo sapiens
gccgcggctggagcgggaggagcaggagatgctgccagccctcccggggccgcgctcgctcagccgccgccaccacacggagcagacgcgcgccgggagccgcgggccgggccagccgggccgccggggcccagtgcgccgcgctcgcagccggtagcgcgccagcgccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttga

SEQ ID NO: 24351 - DNA, 3468 bp, Homo sapiens
cgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttg

SEQ ID NO: 24352 - DNA, 1385 bp, Homo sapiens
agccgccgccaccacacggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttca

SEQ ID NO: 24353 - DNA, 1755 bp, Homo sapiens
attcataggaggcacacataaataatgttggtttaattaattaaattaacaaaaggctgcacctgaagttcagacttggtaaagcaggattttacacattaatttgagaagatctggagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcaggggcatttgggaaatactgatggagaagcaaaacatgtttcttcatggatcttacattctgagggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatg

SEQ ID NO: 24354 - DNA, 5873 bp, Homo sapiens
ttcataggaggcacacataaataatgttggtttaattaattaaattaacaaaaggctgcactacttggtaaagcaggattttacacattaatttgagaagatctggaggcaagtttttattctgacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaatatagaagctttcaagctgtcattctgttttggccctgtgtgaatttggtatattaaattgacgcttgctttttttttcagtagagttttctttttaatcaatcaaacgcctacatttctggaagaaaaagtccaattagatcattacaccttaactaagaaggcaaatcttataaattttgcttgaattgttcttactcaaaactaccttagaatatggtatcttatgaaaatataatattcttaaaattttggaggataaaatgaaaagggtataaacttcaattagaactttaatcctaaaatattgttattcttgtatttttggagttttccgtcccttacaatttctccaaattggtctattccccaagatatccactgttttctacagattttagaatataaaattaaacatatcaacctaaaatctagctatgaatgttatttcaagagttttatatttttaattggctttttaaaaatatgtaattccaatattatagtgaatgttcagtaacttttgttgaaagataatgtggtttaggcttgctaaagaaaggcttgctagaatactaaatttaccttgttatttggaaagagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtggcattcaaaacaaatttattttggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttgaa

SEQ ID NO: 24355 - DNA, 584 bp, Homo sapiens
agttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggctggacttggaatctgtttgaatacgttgtggaataaattccttaatttctaataaatcagtgttatattaattg

SEQ ID NO: 24356 - DNA, 6928 bp, Homo sapiens
gccccgcaagcttccttgggcgcccggcgcgagggactctgagagcccagccgctgcctcggagcccccattcacgtcccctcctcccgctcccccgccaccgcgcctccgactcttctcccccgcgccgcggcgcccaccgcgtctcaggtttaatcccgggttggacctgctggtttgctctccccgctctgagcctcacagccagcccagagaagtggaatctgcactgaaactctgggtggctggagccggcggactgggcatgctcagaagccagggctggctttggtctcaagtaggaagctttggcactcgggaggcagcggcgactttggggaaagttgatcggagaggggaggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaatatagaagctttcaagctgtcattctgttttggccctgtgtgaatttggtatattaaattgacgcttgctttttttttcagtagagttttctttttaatcaatcaaacgcctacatttctggaagaaaaagtccaattagatcattacaccttaactaagaaggcaaatcttataaattttgcttgaattgttcttactcaaaactaccttagaatatggtatcttatgaaaatataatattcttaaaattttggaggataaaatgaaaagggtataaacttcaattagaactttaatcctaaaatattgttattcttgtatttttggagttttccgtcccttacaatttctccaaattggtctattccccaagatatccactgttttctacagattttagaatataaaattaaacatatcaacctaaaatctagctatgaatgttatttcaagagttttatatttttaattggctttttaaaaatatgtaattccaatattatagtgaatgttcagtaacttttgttgaaagataatgtggtttaggcttgctaaagaaaggcttgctagaatactaaatttaccttgttatttggaaagagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtggcattcaaaacaaatttattttggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttgaa

SEQ ID NO: 24357 - DNA, 6487 bp, Homo sapiens
gcggaggggctcagtgaaaaaatgagcgagctagaggaagactttgccaagattctcatgctcaaggaggagaggatcaaagagctggagaagcggctgtcagagaaggaggaagaaattcaggagctgaagaggaaactccacaaatgccagtcggtgctcccagtgccctcgacccacatcggcccccggaccacccgggcgcagggcatctcggccgagccgcagacgtacaggtccttccacgacctccgacaggcattccggaagttcaccaagtccgaaaggtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaatatagaagctttcaagctgtcattctgttttggccctgtgtgaatttggtatattaaattgacgcttgctttttttttcagtagagttttctttttaatcaatcaaacgcctacatttctggaagaaaaagtccaattagatcattacaccttaactaagaaggcaaatcttataaattttgcttgaattgttcttactcaaaactaccttagaatatggtatcttatgaaaatataatattcttaaaattttggaggataaaatgaaaagggtataaacttcaattagaactttaatcctaaaatattgttattcttgtatttttggagttttccgtcccttacaatttctccaaattggtctattccccaagatatccactgttttctacagattttagaatataaaattaaacatatcaacctaaaatctagctatgaatgttatttcaagagttttatatttttaattggctttttaaaaatatgtaattccaatattatagtgaatgttcagtaacttttgttgaaagataatgtggtttaggcttgctaaagaaaggcttgctagaatactaaatttaccttgttatttggaaagagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtggcattcaaaacaaatttattttggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttgaa

SEQ ID NO: 24358 - DNA, 3824 bp, Homo sapiens
attcagcagaagcggatcgaagcaggaggctccccgcgccgcattaggggcgcactccgccgcgctcgagtacttagcgcccattcactcgctcacccgcgctctccgctgccggctgccgtcccagccgccgccgccgccgccgccgccgccgccgcccgagaaaaagtttcgcggaggggctcagtgaaaaaatgagcgagctagaggaagactttgccaagattctcatgctcaaggaggagaggatcaaagagctggagaagcggctgtcagagaaggaggaagaaattcaggagctgaagaggaaactccacaaatgccagtcggtgctcccagtgccctcgacccacatcggcccccggaccacccgggcgcagggcatctcggccgagccgcagacgtacaggtccttccacgacctccgacaggcattccggaagttcaccaagtccgaaaggtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaac

SEQ ID NO: 24359 - DNA, 3328 bp, Homo sapiens
ggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcagagggtcgactagaggtgttccaaggggagaaattgctgtcctccatccctatgtggaccacatttggggagcttgccattttatacaattgtacaaggactgcctctgtgaaagctattaccaatgttaaaacatgggcactagatcgagaggtattccagaatataatgaggaggacagcccaagctagagatgaacaatacagaaacttcctcagaagtgtatccttgctgaagaatttacctgaagataaattaaccaagatcattgactgcttggaagtggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgttaaagtggcagttttttctgcaatctattgttccattccaatcatatccttctcgtttgagtactactaacgtttaaaaagggtcttgcccttgaataactaagtcatacaaatagaaggaaaaacaatggtgaattttggagagctccccagctctcagcaacttcatataagcatggtggtatcttaaaatggtggtttgcagaaaccatggtagccaacagaacctcctgactttcacctgcttttaacctgaaaatatattaatacgcctctgacatgagtccagggagaggcaagattgagcaatagtcagtggcaccatttcctaaagtaactgaatcaatcaatccagtcaggtaattattttctattggggaacttagaaaaaaaagtaaagcaagaaatattttctctcctttatgatcagtgataccttagagacttttcgaaagtccttgttaaagatagttacaatgtgtggttaaatgatgctaaaatattttcacaaccagagtagaaaacgtgctggaacaaaattgcgaaggcttttgcctcccagtaaatagaaaggaaaatatattctagtaggtaagactgctgactctttgaaaatctgaggtattttgaaaaattctgtgatagttgctattaataaaccaaaattgtatagaatcatcgttaatttttaatataaatcccattgacaaatgttgatgcactgtagtcactgctgagttaatagcg

SEQ ID NO: 24360 - DNA, 3431 bp, Homo sapiens
aggcggctggggagggcggcgtgggagaggacgctgagacgcaggggcggccgcgccgaggtgacaagctgcgcacctggaaagttacccggctgtctggtgaggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcagagggtcgactagaggtgttccaaggggagaaattgctgtcctccatccctatgtggaccacatttggggagcttgccattttatacaattgtacaaggactgcctctgtgaaagctattaccaatgttaaaacatgggcactagatcgagaggtattccagaatataatgaggaggacagcccaagctagagatgaacaatacagaaacttcctcagaagtgtatccttgctgaagaatttacctgaagataaattaaccaagatcattgactgcttggaagtggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgttaaagtggcagttttttctgcaatctattgttccattccaatcatatccttctcgtttgagtactactaacgtttaaaaagggtcttgcccttgaataactaagtcatacaaatagaaggaaaaacaatggtgaattttggagagctccccagctctcagcaacttcatataagcatggtggtatcttaaaatggtggtttgcagaaaccatggtagccaacagaacctcctgactttcacctgcttttaacctgaaaatatattaatacgcctctgacatgagtccagggagaggcaagattgagcaatagtcagtggcaccatttcctaaagtaactgaatcaatcaatccagtcaggtaattattttctattggggaacttagaaaaaaaagtaaagcaagaaatattttctctcctttatgatcagtgataccttagagacttttcgaaagtccttgttaaagatagttacaatgtgtggttaaatgatgctaaaatattttcacaaccagagtagaaaacgtgctggaacaaaattgcgaaggcttttgcctcccagtaaatagaaaggaaaatatattctagtaggtaagactgctgactctttgaaaatctgaggtattttgaaaaattctgtgatagttgctattaataaaccaaaattgtatagaatcatcgttaatttttaatataaatcccattgacaaatgttgatgcactgtagtcactgctgagttaatagcg

SEQ ID NO: 24361 - DNA, 2623 bp, Homo sapiens
gagctgacctgcgctgggctccggcgccgcaggcggctggggagggcggcgtgggagaggacgctgagacgcaggggcggccgcgccgaggtgacaagctgcgcacctggaaagttacccggctgtctggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcagagggtcgactagaggtgttccaaggggagaaattgctgtcctccatccctatgtggaccacatttggggagcttgccattttatacaattgtacaaggactgcctctgtgaaagctattaccaatgttaaaacatgggcactagatcgagaggtattccagaatataatgaggaggacagcccaagctagagatgaacaatacagaaacttcctcagaagtgtatccttgctgaagaatttacctgaagataaattaaccaagatcattgactgcttggaagtggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgtt

SEQ ID NO: 24362 - DNA, 1729 bp, Homo sapiens
catcccaacaggaatactatgacaaaggagattacatcattagagagggcgaggaaggaagtacctttttcattttggcaaaaggaaaggtcctccactttggacagataaaggagcttctaccagtagagtcccatgcaattctgtttgaacactggctttggagtggaggccacaggaccccctaagaaataataacttcttagtgatgttatgtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacatta

SEQ ID NO: 24363 - DNA, 1826 bp, Homo sapiens
gcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacata

SEQ ID NO: 24364 - DNA, 1344 bp, Homo sapiens
gcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacaggtgcgccccagcctcgccagctctggccctggcctccggggaactcggcgcctccctcgtcaccgtcggtggcggttaaaactggcctctacgcttctgcttcaatctccaatttggcatgcaaagcacacctttttgtggtttttgcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccat

SEQ ID NO: 24365 - DNA, 1616 bp, Homo sapiens
gaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgataaaatgggaattactaagctgtaatcaggcctaaagtggcctgacttaatacagagactttctcacttctccatcacaattatttgggtagcttcggcatgcagcattctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgt

SEQ ID NO: 24366 - DNA, 1211 bp, Homo sapiens
gcggcgcgcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactcca

SEQ ID NO: 24367 - DNA, 6031 bp, Homo sapiens
gagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagtgcttcttacctggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagtgtagtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacatgtggagctagaaggaaaagcttttaagtctcatgtttgctgactataaaaataaatcatagtaataatattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtggctcacgcctgtaatcccagcactttgggaggccgaggcaggtggatcacctgaggtcaggagttcgagaccagcctggccaacatggcaaaacccccatctctactaaaatacaaaaattaggtgtggtggcgggcacctgtaatcctggctactcgggaggctgaggcaggagaatcgcttgaacccgggaggcagaggctgcagtaagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcagaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagttcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtgtgtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgccggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttgtttaataaaactttgtatcttttcagaa

SEQ ID NO: 24368 - DNA, 2728 bp, Homo sapiens
ggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctgatggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 24369 - DNA, 2388 bp, Homo sapiens
aagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctgatgagtgaagaagccaccctcagtcaccccaattttcctggagccacccccaaaggaggagggagccccaggagccccagaacagacatgagacctcctccaggaccctgcggggctgggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataa

SEQ ID NO: 24370 - DNA, 2934 bp, Homo sapiens
ctcagactgagggagaatcaattttgggggagaccacatctaatggataaaagagccacaggattacaaaagggtggaatagttgttacaagaaggtcacatcatcctggcactgctcccagaaccagtgggcctcgaagcccagcttggcactctcatcctctggtgactcaggtggtccaccttgaagcctctcccctgggggcttccacacagctctcaagctccctagcctggtggctgccacatccacctcagtcctggccctctctccaccagctataacttttgcccagtccatctcggaacgtggagccccaggtgggccctgttcatccagctcgctgggggccactgtgtccaggaagctgccaatagagacactgtccagccggtcggtggtgctggtgtctggcaggctgtcccagctgcctcgccttgagcggcctgggctcccgcctgtcaggctatattgactgctggtgaggctgctgcaatgactggtcaacgtcccccgctcctccaacagccagcgcactgcctcgatgccctcattcaaggtcaccagctgctgcaggatcttcacatcgatggctcgcagattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctgatgagtgaagaagccaccctcagtcaccccaattttcctggagccacccccaaaggaggagggagccccaggagccccagaacagacatgagacctcctccaggaccctgcggggctgggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 24371 - DNA, 3480 bp, Homo sapiens
gaatcaattttgggggagaccacatctaatggataaaagagccacaggattacaaaagggtggaatagttgttacaagaaggtcacatcatcctggcactgctcccagaaccagtgggcctcgaagcccagcttggcactctcatcctctggtgactcaggtggtccaccttgaagcctctcccctgggggcttccacacagctctcaagctccctagcctggtggctgccacatccacctcagtcctggccctctctccaccagctataacttttgcccagtccatctcggaacgtggagccccaggtgggccctgttcatccagctcgctgggggccactgtgtccaggaagctgccaatagagacactgtccagccggtcggtggtgctggtgtctggcaggctgtcccagctgcctcgccttgagcggcctgggctcccgcctgtcaggctatattgactgctggtgaggctgctgcaatgactggtcaacgtcccccgctcctccaacagccagcgcactgcctcgatgccctcattcaaggtcaccagctgctgcaggatcttcacatcgatggctcgcagattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggtaagcctgggaatgggctatacccagcactgaacaggagggtgcttaggtcatctacctccaggaggaactcttgaggtgggcagaaaggcaatagattctagacgcattcacctctgtgggtaagcatagggactctgggcccagctgtaaacacaggggaacctgagttgaggggtgatgaagtgaccctaacctatccctgggctccccaggatgctgcgctctctgctttcagcccagggggtgtctcctcagatgataacagttttcattgacggctactatgaggtgagcaggacttggggggtgcctcgggtggagtacaacatggagcagcagtgattgccagggacgggcaagggagaccgcccaggcaagggctgtgaaatgtgaaggccttggattgcagaggtgggcagagggaaagtgacctcacatggtgagcagtggccatgtcccccaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctgatggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctgggg

SEQ ID NO: 24372 - DNA, 2355 bp, Homo sapiens
ctgatcaggctggctttgcagagaggcacacccctgtgaggcagttagggccaggacccaggtctgatcccccgcttgggtccctgggcctggctccatctctagaaaccaacaatggaggggaccaaggaaatcaaggtctcaaatagaagaatacaggagcactggacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctgatggtgggggtcccggcttccccctactcagtgaagaagccaccctcagtcaccccaattttcctggagccacccccaaaggaggagggagccccaggagccccagaacagacatgagacctcctccaggaccctgcggggctgggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctg

SEQ ID NO: 24373 - DNA, 1054 bp, Homo sapiens
cggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaaggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacg

SEQ ID NO: 24374 - DNA, 1808 bp, Homo sapiens
aaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggagttgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcggatttctgctctactggacaacaaagataaggtgcagtttgggagggtatgggggaattccaaggcagttttttttttccatgaaaattcaatcttaggaacaaatgaaaatattttctagtccttaagttgattttggaaatgcaaagtctttaaagagagagaggcacactgatagtttattcaagtagctatttgcttgctattgtttgcttgaccaaaaaagaaaataaaaaagctttaaaaata

SEQ ID NO: 24375 - DNA, 5369 bp, Homo sapiens
ctctcccgggattttgctgccgggctccctctctctgcggccctagagttaatcccatcagccgagatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagaacactgtggctgaattgcaaggaatgtctggcaactgcaataacaataacaactattttcttaagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccagcaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaaggtagaaaacacatggattacaaaagcaaacaagagaaacccaaatccctcctcttcttcaatctttggaaggcattctcaacttatgtctgtagtctggatccaagaaaccaataattttaccttcaatgatgacttcagtcccagcagtaccagttcagcagacctcagcggcttaggagcagaacctaaaacaccagggctctctcagtccttagcactgtcatcagatgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctg

SEQ ID NO: 24376 - DNA, 1389 bp, Homo sapiens
gcggcgccgccatgtccgacagcgagaagctcaacctggactcgatcatcgggcgcctgctggaagggtccagggtcctgacaccccattgcgccccagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctc

SEQ ID NO: 24377 - DNA, 1476 bp, Homo sapiens
gcggggcgggcccgggaggcctggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaa

SEQ ID NO: 24378 - DNA, 1685 bp, Homo sapiens
cttcttgctgacgccgccagcgccgaccaccagcagctgttttccctccatgaggcagcgcgccgaccgccgaagcatggtctccaccagcggcgccgccaccgcctcgtcggccgccggccccagccgcggcgcggcccacagcccctccagcgcgccgcacgcctccagacacaggccgccgttcagctccagggccactgggcttctccagcagcgccagcactgtgtccaccactgcacccagctctgcccgcgggtgcagacgccatgcctgccgcccccgccagcgccagccactgagcttcacagctacctgcagcaaggaggggaaaggggcctcctggacaccaccccaggtactgcagggtggggcacttccgccacaggagccgtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctc

SEQ ID NO: 24379 - DNA, 3527 bp, Homo sapiens
ggcgctggtgagctttgcggagctgggcggtgccgaggaggaggaggtggcggcctgggtctgacgcggccctgttcgagggggcctctcttgtttatttatttattttccgtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttagga

SEQ ID NO: 24380 - DNA, 4771 bp, Homo sapiens
gctgcgtgacgcggcggcgcgcaagggacgtgcggagtgagtggcgctgcgggtggggccgtcggcggcgctggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatataagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttattttt

SEQ ID NO: 24381 - DNA, 4893 bp, Homo sapiens
ggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatataagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatga

SEQ ID NO: 24382 - DNA, 570 bp, Homo sapiens
agtgcggttgcgcggcggcccaggcgtcgaggggagcctcggcggggagcgcaccgcgcgcctgcgcggagagctgcgtgacgcggcggcgcgcaagggacgtgcggagtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgag

SEQ ID NO: 24383 - DNA, 584 bp, Homo sapiens
gcgcggagagctgcgtgacgcggcggcgcgcaagggacgtgcggagtgagtggcgctgcgggtggggccgtcggcggcgctggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaat

SEQ ID NO: 24384 - DNA, 721 bp, Homo sapiens
cacctgcgcgaagacggcagcgggagaagccgctccagtgcggttgcgcggcggcccaggcgtcgaggggagcctcggcggggagcgcaccgcgcgcctgcgcggagagctgcgtgacgcggcggcgcgcaagggacgtgcggagtgagtggcgctgcgggtggggccgtcggcggcgctgtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacag

SEQ ID NO: 24385 - DNA, 2559 bp, Homo sapiens
ttttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaaccacacggttgcattttggttttgcttctttcaaatagtctgttttccaaagatggattataatacagatactaatactctttgagttgtaacctggagacatctatttgtgtaatagagtgatgaggtggaac

SEQ ID NO: 24386 - DNA, 1472 bp, Homo sapiens
atccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaagggttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgtt

SEQ ID NO: 24387 - DNA, 2154 bp, Homo sapiens
atcagaacgagacttagttacatattttggggtccaaaagtgaactttataactgtaaaattaaggtacatttagcagttccgtgctactttatctgtatctaatgactatccagtctgttacaactggaaccaaaacaaaatttctttcccacaactacctacgtgctgacaagtgagttctgttgcaaagtttgtactttgatagaagaaccctaagtgctctggtggtgtggatgccccatgctgtgcaatgatttctttctcccattattatcttatctgttcaaattattagggaacgtgctttcttacagtatagcacatgactgacatcctttgccctatatagacatgagcataaacacaaatgcaggcccagaaaatgcatggcaaaataagtacaatgaaccaacattttcttaatgaaatgaaaacaacactaacattttttcataggtaaattaaatcagagatcctcaggaggagatacccatggtcctctggaaaacactgatgggggagggttctgagtatttccaatcctgtttcttttcttttcttttctttccttttcttttttttttttgagacggagtctcgctgtgttgccaggctggagtgcagtggcgcgatcttggctcactgcaacctccgcctcccgggtgcaggcgattctcctgagtagctgggattacaggtgcacgccatgttggcgaggatggtctggatctcttgacctcatcatgatctgcccgcctcaccctcccaaagtgctgggattacaagcgtgagccattgcatctggcctgcagtcctgtttctaacagcattcgcacagacaggatggctccttttttggaatactataaaagaagtcttacttggtatcgaagatgcaattaagtcttgtctaagattttaagattctaattagacattaaaaccatgtttattataagtgtcctgaaaatgaagccactcagaaagctagttaaaccatgtttttgcccctttatctaaatctcgtattgtattttgtattttggcttcattggactaattgcgatttttctcttgcagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctgg

SEQ ID NO: 24388 - DNA, 2797 bp, Homo sapiens
aattttggagcatcttggattaaggatactcatcctgtggtggtagtagtagtagtattgctgttggaaatgggagttggtggtttttggagattgcccttcagcctttcgtaagaaggagtttgcttttttttgagacggagtttcactcttgttgcccatgctggagtgcaatggtgcgatcttggcttactgcaacctctgcctcccaggttcaagcaattttccttcctcagcctggcgggagaagtttgttaaactttccgaaccccctagtgaaggacctctaaagaaatatgcaacagggtgaaccatagtcagtgttagacccagtcattgagaaaccagaaattattaggagaaaagataacactcctctgcagagagaaggcaaacatttgttgaatttacatttcatttcaagccctgtggtaaactccctaagctgcttgatttgcattacagggtgggaggtgtggttcaggtcagttgcttgggctggctctaactctcaaaggagaggtataggtttaaacctttagatgtccctgtattccccaggaaaagagactaaggacaaactcttggtttgttttgtttgttttgttttgttttttgagacggagtttcgctcttgttgcccaagccggagtgcaatggcacaatcaaggctcaccgcaacctccgcctcccaggttcaagtgactcttctgccttagcctcccaagtagctgggattacaggcatgcgccaccacgcccagctaatttttatatttttagtagagacgggatttcttcatgttggtcaggctggtctcaaactcccaacctcagatggtctgcccgcctcggcctcccaaagtgctgggattacaggtgtgagccaccgcgcctggccaaactcctggtttttaaagattgtgcttagtatagtaagtacaggaaacaaaggcatctggacaattggacaatcctcaaccaatccagagaaatttgttcttgcaaggtatgtgactaggttttaaactcagaacatcagtttcctgtagaaacagtgcatagaggcatatttctgtcagaactgcactctgactccagaatgtgtggatgcctgtgctgttgagggaacatgaccatcctgtgacatcaggcctgtgggagcatgtggagtctgtgcagtgttggaaacaaatgccctgtagtgcctgtgagaggcagccactgccgtgtgatcattgtgcctcctgctagagtactgagggctggggatcctctggtgtcagtaggttattgaggggcatatatgggggatgggtgctaactctcaggtttcctcagaaggaaggtcataacgccacatgtgtaagttcgtaattgaattcagaagtaggggactagctgcggtgagattggacagagcagacaatttcaaacagaattgatgctcccagataattcctgggatttgatggcagtccttaatcattatcaaatctggaattctggtttcatgcttctgtggaatttaaaaagatttcatgtgaaaatgtaagtcattgcttttagatcagatatgtgtctctcctaaaccccttccctctaggagagtctttctttaaagagatggggtctcactatgttgcccaagatggtcttgaactcctgggctcaagccatcctcctacctcagcctcccgaagtgctgggattacaggtctgacccaccacgcccagctcttattttaaaagagccttaaaataagatggttttattaagattcttaataaaaacatagtttcatttgcttaaaaggcacccagaatcttgctttgggggaagttaatcctgagagaatgagcctacggaacagtaatactctctttttaatgtaatactctctttttaatcacaggtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacc

SEQ ID NO: 24389 - DNA, 1723 bp, Homo sapiens
ggaaaaaggaagggagatcaaagattaggtgctggggactgaaaaataattttcatgtattaatactaccaaggatgatttggggaggaagacggagaaacagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgattgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 24390 - DNA, 1464 bp, Homo sapiens
gggatatgggaggtgtggggttgaatatctagggctgggagaatcggaaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 24391 - DNA, 1536 bp, Homo sapiens
ggattagaagagttgttggaggagctaggcctagggatatgggaggtgtggggttgaatatctagggctgggagaatcggaaggtattggagctatttggagtggcagagatggtgcaggaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 24392 - DNA, 1689 bp, Homo sapiens
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 24393 - DNA, 1731 bp, Homo sapiens
ctttctttcagcgcctgcgcgctgtcacgttacggcggaactaatccagcgacgcctgcgctttgacgcatttggtgccgtggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 24394 - DNA, 1640 bp, Homo sapiens
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 24395 - DNA, 1731 bp, Homo sapiens
ctttctttcagcgcctgcgcgctgtcacgttacggcggaactaatccagcgacgcctgcgctttgacgcatttggtgccgtggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24396 - DNA, 1723 bp, Homo sapiens
ggaaaaaggaagggagatcaaagattaggtgctggggactgaaaaataattttcatgtattaatactaccaaggatgatttggggaggaagacggagaaaaagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactggttgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24397 - DNA, 1464 bp, Homo sapiens
gggatatgggaggtgtggggttgaatatctagggctgggagaatcggaaggatgatttggggaggaagacggagaaaaagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24398 - DNA, 1539 bp, Homo sapiens
cagggattagaagagttgttggaggagctaggcctagggatatgggaggtgtggggttgaatatctagggctgggagaatcggaaggtattggagctatttggagtggcagagatggtgcaggaggatgatttggggaggaagacggagaaaaagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24399 - DNA, 1689 bp, Homo sapiens
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaaaagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24400 - DNA, 1640 bp, Homo sapiens
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24401 - DNA, 1464 bp, Homo sapiens
gggatatgggaggtgtggggttgaatatctagggctgggagaatcggaaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24402 - DNA, 1689 bp, Homo sapiens
ccggaagcggcgagccggaagtggggttagccaggttatccccaggggtggagaagcggaggcccaggaggagggggaataaagaaggtggaggatcctggctaccaatctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24403 - DNA, 1536 bp, Homo sapiens
ggattagaagagttgttggaggagctaggcctagggatatgggaggtgtggggttgaatatctagggctgggagaatcggaaggtattggagctatttggagtggcagagatggtgcaggaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24404 - DNA, 1689 bp, Homo sapiens
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24405 - DNA, 1536 bp, Homo sapiens; identical to SEQ ID NO: 24403

SEQ ID NO: 24406 - DNA, 1723 bp, Homo sapiens
ggaaaaaggaagggagatcaaagattaggtgctggggactgaaaaataattttcatgtattaatactaccaaggatgatttggggaggaagacggagaaacagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgattgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24407 - DNA, 1464 bp, Homo sapiens; identical to SEQ ID NO: 24401

SEQ ID NO: 24408 - DNA, 1689 bp, Homo sapiens; identical to SEQ ID NO: 24404

SEQ ID NO: 24409 - DNA, 1640 bp, Homo sapiens
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24410 - DNA, 1723 bp, Homo sapiens; identical to SEQ ID NO: 24406

SEQ ID NO: 24411 - DNA, 1614 bp, Homo sapiens
ccggaagcggcgagccggaagtggggttagccaggttatccccaggggtggagaagcggaggcccaggaggagggggaataaagaaggtggaggatcctggctaccaatctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24412 - DNA, 1607 bp, Homo sapiens
cggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24413 - DNA, 1536 bp, Homo sapiens
ggattagaagagttgttggagaagctaggcctagggatatgggaggtgtggggttgaatatctagggctgggagaatcggaaggtattggagctatttggagtggcagagatggtgcaggaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24414 - DNA, 1640 bp, Homo sapiens; identical to SEQ ID NO: 24409

SEQ ID NO: 24415 - DNA, 1464 bp, Homo sapiens; identical to SEQ ID NO: 24401

SEQ ID NO: 24416 - DNA, 1731 bp, Homo sapiens
ctttctttcagcgcctgcgcgctgtcacgttacggcggaactaatccagcgacgcctgcgctttgacgcatttggtgccgtggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24417 - DNA, 1536 bp, Homo sapiens; identical to SEQ ID NO: 24403

SEQ ID NO: 24418 - DNA, 1640 bp, Homo sapiens
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24419 - DNA, 1731 bp, Homo sapiens; identical to SEQ ID NO: 24416

SEQ ID NO: 24420 - DNA, 1536 bp, Homo sapiens; identical to SEQ ID NO: 24403

SEQ ID NO: 24421 - DNA, 1640 bp, Homo sapiens; identical to SEQ ID NO: 24409

SEQ ID NO: 24422 - DNA, 1464 bp, Homo sapiens; identical to SEQ ID NO: 24401

SEQ ID NO: 24423 - DNA, 1536 bp, Homo sapiens; identical to SEQ ID NO: 24403

SEQ ID NO: 24424 - DNA, 1689 bp, Homo sapiens; identical to SEQ ID NO: 24404

SEQ ID NO: 24425 - DNA, 1689 bp, Homo sapiens; identical to SEQ ID NO: 24404

SEQ ID NO: 24426 - DNA, 1731 bp, Homo sapiens; identical to SEQ ID NO: 24416

SEQ ID NO: 24427 - DNA, 1640 bp, Homo sapiens; identical to SEQ ID NO: 24409

SEQ ID NO: 24428 - DNA, 1689 bp, Homo sapiens
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24429 - DNA, 1723 bp, Homo sapiens; identical to SEQ ID NO: 24406

SEQ ID NO: 24430 - DNA, 1723 bp, Homo sapiens; identical to SEQ ID NO: 24406

SEQ ID NO: 24431 - DNA, 1464 bp, Homo sapiens; identical to SEQ ID NO: 24401

SEQ ID NO: 24432 - DNA, 1723 bp, Homo sapiens; identical to SEQ ID NO: 24406

SEQ ID NO: 24433 - DNA, 1731 bp, Homo sapiens; identical to SEQ ID NO: 24416

SEQ ID NO: 24434 - DNA, 1640 bp, Homo sapiens; identical to SEQ ID NO: 24409

SEQ ID NO: 24435 - DNA, 1723 bp, Homo sapiens
ggaaaaaggaagggagatcaaagattaggtgctggggactgaaaaataattttcatgtattaatactaccaaggatgatttggggaggaagacggagaaacagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgattgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24436 - DNA, 1464 bp, Homo sapiens
gggatatgggaggtgtggggttgaatatctagggctgggagaatcggaaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 24437 - DNA, 982 bp, Homo sapiens
gacagagaaagcgcttcggcggctgcagctcgggcggcggccgcgggggacaaagggcgggcggatcggcggggagggggcggggcgcggccaggccaagcccgggggctccgcatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgacggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgca

SEQ ID NO: 24438 - DNA, 2152 bp, Homo sapiens
agagcaggtgccggggagcccttcgcatgcggctgccgggccggaggtggtagcggcgccgggcgcgctccgcccgcccctcctccgggccgcactgaggctcgggcgcgcggggacatgtcggtggcgacgggcagcagcgagacggccggcggggccagcggcggcggcgcacgggttttcttccaaagcccccggggtggcgccggtggcagccccggctccagcagcggctcaggctcctcccgggaggactcggcgcccgtggccacggcggccgctgcagggcaggttcagcagcaacagcagcggcgacaccagcagggaaaagtgacagtgaaatacgatcgtaaggagcttcggaagcggctggtgctggaggaatggatcgtggagcagctgggtcagctctacggctgcgaggaagaagaaatgccagaggtagaaattgacattgatgatcttcttgatgcagacagtgatgaagagagagcttcaaaattacaggaagctcttgtagactgctacaaaccaacagaggaatttatcaaagagctgctttctcggataagaggcatgaggaaactgagccctccgcagaagaagagtgtatgattctggaacagggtgaaactctcccagagacgaagaaagagtcctgggatttgtacttcatgaagacttttgtgaaagaataggtgtccttatgaacaacgtttttgtttttttttttttcttttttggtgtgaaggtgggggggtctattagacatttattcaagagcgttctttttttggttttaaaggtttttgttaatgtaatattttaatagcaaagatatcatgactctagccacagcctaaccaaggattatcaaaggaggtggacactcaaggaagggccacgccaggctgcgtttcctgcaaggactcagatgttcagtaccttatgatacagggaagatagttttcttacaagtagtttggtaatattttttttcttaagttgtacatttgactcagctgtcaaatttctcacacttgtatatatctacacacaactaagttaaaatgttgatgtgagttttatttcacatggatggaataaacttgtggttgtcctttaactggaggtcccagcacatgtgttttcaagaggccactaggcattcttcactgagtgctgctgacttcaacgttcactttatgcaccaaagtgaaagaattcagtgtatccgttattttaatgcactacaccacagaaatgttaagttggtcaagggcttaatttatggaatttctattatttcattggttgggatgctttgccaggtcatgtgcttattgtctcattttgtagtcttttaaagttgtatgaacccttaatttgaagaactaacttgatttctagagaaatatccacactatctcagtggtattttgcattggaaaaaggaagcactgtgtagcagtgaattgtctgctttccaccgagtactgtgtttattctctctccaggaaagcagatcaaaagaaagttagcagatcgagtgtcttcttccttagaaataggttctggtagcttctgtgcctgggtagtatcagaccagtgggagtaaaccgagtgttaagtgtcaaggtgagaaagcctcacattctctcaagacagttgctctaggagctgagttgctggtttggaagtgtggagattgcatttctggcttctctcaatggcttgtgttgaggactctgggtgctcctggccctaattgtgcaccctgatccccgtgcttggagctaggcctggtggcgtgctctagccctctcagttaccagctctttggagaaggatcaaaattcagatggaatgtgggatgggtaataggtgagagtagaaacccttccctccaggaggcccccgctgactcccacagaaacccacctaccataagatgtcttcaggtggccttgtccaaggatgggggtcaggcattttatatcaagggtgctctgaacatattttattttttaaaaaaactatgtttgtgaattttgcgtatactggcaagcttttgaaaatgtatttaattttgtattgtttaccaatgatttatttacaagatatttactcaaataaatggagctgcttacaa

SEQ ID NO: 24439 - DNA, 757 bp, Homo sapiens
cacttccctctgtggctctgctcagaactggcggtttttcccagctccttgcccagaccaatacttccatgctgtcttcaagccctgcttcctgcacatctcccagcccagatggggagaacccatgtaagaaggtccactgggcttctgggaggagaaggacatcatccacagactcagagtccaagtcccacccggactcctccaagatacccaggtcccggagacccagccgcctgacagtgaagtatgaccggggccagctccagcgctggctggagatggagcaatgggtggatgctcaagttcaggagctcttccaggatcaagcaaccccttctgagcctgagattgacctggaagctctcatggatctatccacagaggagcagaagactcagctggaggccattcttgggaactgcccccgccccacagaggcttttatctctgagctgctcagtcaactcaagaaactccggagactcagccggcctcagaaataagcctgagagaccatctttagcagcctcagcactgccaggcctgccctgaaactccagatcctggctaagagggaaatagctccttgggacacaaacaagaaatgtggacaaggagggacatttgcatactcctactgtctgtgtggtcacagctagtttctgtcagctgggctctctgggagaaagctggctgttgtccaatgccttccttggcagccaagtggataaaacctttaggagccccagctcaa

SEQ ID NO: 24440 - DNA, 871 bp, Homo sapiens
cacttccctctgtggctctgctcagaactggcggtttttcccagctccttgcccagaccaatacttccatgctgtcttcaagccctgcttcctgcacatctcccagcccagatggggagaacccatgtaagaaggtccactgggcttctgggaggagaaggacatcatccacagactcagagtccaagtcccacccggactcctccaagatacccaggtcccggagacccagccgcctgacagtgaagtatgaccggggccagctccagcgctggctggagatggagcaatgggtggatgctcaagttcaggagctcttccagagtcttgctctgtcacccaggctggagtgcagtggtgtgatccattctctgcaacttctgcctcccgggttcaatcgattctcctgcctcagctcctggagtagctgggattacgggatcaagcaaccccttctgagcctgagattgacctggaagctctcatggatctatccacagaggagcagaagactcagctggaggccattcttgggaactgcccccgccccacagaggcttttatctctgagctgctcagtcaactcaagaaactccggagactcagccggcctcagaaataagcctgagagaccatctttagcagcctcagcactgccaggcctgccctgaaactccagatcctggctaagagggaaatagctccttgggacacaaacaagaaatgtggacaaggagggacatttgcatactcctactgtctgtgtggtcacagctagtttctgtcagctgggctctctgggagaaagctggctgttgtccaatgccttccttggcagccaagtggataaaacctttaggagccccagctc

SEQ ID NO: 24441 - DNA, 1826 bp, Homo sapiens
agagtccccggagccgcgagctgggagcgctgtgccgggagccgggagccgagcgcgccgggctggggccggggccggagcggagcggagagggagcgcgcccgccccagccccgagtcccgccgccttccctcccgccgcagcgcgggcccaccggccgccgccccagccatggagcaagacaacagcccccgaaagatccagttcacggtcccgctgctggagccgcaccttgaccccgaggcggcggagcagattcggaggcgccgccccacccctgccaccctcgtgctgaccagtgaccagtcatccccagagatagatgaagaccggatccccaacccacatctcaagtccactttggcaatgtctccacggcaacggaagaagatgacaaggatcacacccacaatgaaagagctccagatgatggttgaacatcacctggggcaacagcagcaaggagaggaacctgagggggccgctgagagcacagaaacccaggagtcccgcccacctgggatcccagacacagaagtggagtcaaggctgggcacctctgggacagcaaaaaaaactgcagaatgcatccctaaaactcacgagagaggcagtaaggaacccagcacaaaagaaccctcaacccatataccaccactggattccaagggagccaactcggtctgagagaggaggaggtatcttgggatcaagactgcagtttgggaatgcatggacaccggatttgtttcttattccttcacttttggggaaaatctcttgtttttaaaaagtgataaatttggtgttaggtccttggcactttccttcttttccaactgggagaatcctttctccctgccttcttgccctgccctctctgtagcccccaccctcctgccaagctgcctctgggaaggaagaaacaggagctaggcagaagccttgagcagggaagagttcttcccttagccctgactttacttgctgtgggaagagagatgagggtcagataggtgggaggactaacttccagggtgccaagaaggaagaaaagccccaggttctcttttcttattgaggaacgatccgaccacctcacaggcctgccctgcagctggaagactcggcgctctaaggcctgtgccgtgtccagctgtgactgtgcggtgggctccatctgctggacaaaaggggaactgcaccatggcacttggcccatgggaaagagggtatggtggtgtgccgatacctcctcgcctgccctccaagccccagctgccttccttttggattcccaagcttcaggatgtgttccctcttccagctgtgggaccgctgtcccttatttcaacccgttagcaacaatggatagagaacacagtggctattaatgaagaggcccatgctggagactggaagggttcccttgtcctagacattgaggggcccagataagaccaaaaccaagcataagagaagaaactgtctcagatctcacggccaggcctctctcctgctgctgtttttgattttcccaggtagtgggagagaggaaaggagggaaggcaagattctttccccctccctgctgaagcatgtggtacagaggcaagagcagagcctgagaagcgtcaggtcccacttctgccatgcagctactatgagccctcggggcctcctcctgggcctcagcttgcccagatacatacctaaatatatatatatatatatatgagggagaacgcctcacccagattttatcatgctggaaagagtgtatgtatgtgaagatgcttggtcaacttgtacccagtgaacacaca

SEQ ID NO: 24442 - DNA, 633 bp, Homo sapiens
agagtccccggagccgcgagctgggagcgctgtgccgggagccgggagccgagcgcgccgggctggggccggggccggagcggagcggagagggagcgcgcccgccccagccccgagtcccgccgccttccctcccgccgcagcgcgggcccaccggccgccgccccagccatggagcaagacaacagcccccgaaagatccagttcacggtcccgctgctggagccgcaccttgaccccgaggcggcggagcagattcggaggcgccgccccacccctgccaccctcgtgctgaccagtgaccagtcatccccagagatagatgaagaccggatccccaacccacatctcaagaaactgcagaatgcatccctaaaactcacgagagaggcagtaaggaacccagcacaaaagaaccctcaacccatataccaccactggattccaagggagccaactcggtgtcataggagaggagggactgggggacagaagagcgtgggaggatttccctgctccacccacactttggctccattctatgtcttcactcgctccattttactgctcaaaaggggagagagaatgtcgcatccactggagcccagagacgacccaacaaagatgccatga

SEQ ID NO: 24443 - DNA, 3004 bp, Homo sapiens
attgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgccatcctgctagtaaagatttattcaattatttataattaattaagtggcttcacctatatttctgttaataatcacattaattatgtatgacaggtaggatttatgttatagataagaaaactagagtccaaagaaaataagtgtccccaaatgaaccaataatccaacaaacgcttccactaactagcttctgacctgtttgagttgtgatagattttagaataaaaaagcctatcctccttaggagccatagacttttattctttcttatactgtcttatatattgacttagagctaaacttcctccaattcagacataaagcataggcagatacttttgctaatgaggctaagctgggaagaaaaccctgagttctactttaattcttgggcattgacttcaaactaagatgacttataagaaataaaagaagtaaatttgaaactttaataaaaaaagtacatggttcatttaaaaatgtttcctatgtctaaatctatattttaaaaataacctttatcatgtaaaatgagagaattgctgagtttatgacaatcttaggtataaccttttcttaaagaacaaggcatcaatctttaatttgtttccctttcttgatttctcataagttgcaaaataaaaataaaaataatttcacaaattgttcattattattatcctccctacttgccccaggatttaagtactaacttttacttcctactcttagactttgtattgccaaagaaataaaatatgaaaaagcataatcacccagacctacctgcggaattgtggattatgctgtagatattagatcattgaaaggaacaatatactacttaatgaggagccaaagacaacattctacctgctgctcccttcaagctgaggaatgagtttaattgacttcaaagtcccattattctcaaaagtagcaaaggtacaacatggctttgcatgaatcaaaggaagggaacaacaagaacttaaaaaaatagtttgcagatggttgaacatctctttaataattagagaagaatatcttttctttctttattgtttacagataccaacatttttcaaagccttgcagtagatgagtgagtctcctgttacatttctcctgcagcatatattctgtggatgtgttttcctaagcagactaattatatgttgctctcttcttttaccctaatgaaacatagatttttctgttttgaatttgtcacttgtttgttacatttgtcaagtgttttaaatattacattggtcctttatttgcttttgagaacacccaatagtttaaaaattaaaatgacatgaaggtcaattctaagacaggaatgatactactaaatcctggacttgcctatgataacaagctcgagctacacacttttattgtcagaataaatggaatatataggaaggagttaattggaactggttagtacctaaataagatttttcaaagtaagttttttgtcgtattggcagaacagtgttaaaaaatagacattgtcatcataaacacccacaactatatctgtagaagataatttaatgcaatattctggggaaaatacagttgccaaaattaatctccttgttttctttcattgtgcaatgtggagttaaattttttttctattgagcagtgtgtgtgtgtgtttgtgtctataatttatatatgtgcttgtatacatttctatatacacatgtatgtgtatgcaaaatatgtatatatacacatatatataaaatgtacactaaatatgtatatatgtatattcataaaatgttttgctgtatggaaataaaaaagaaggtttctaaaggaaagatagagaagaaa

SEQ ID NO: 24444 - DNA, 1157 bp, Homo sapiens
ggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgcc

SEQ ID NO: 24445 - DNA, 1014 bp, Homo sapiens
gtattagtgaagaggcacacaattagcgtattgttcctttctgtattgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacatttagacatga

SEQ ID NO: 24446 - DNA, 3452 bp, Homo sapiens
gttctcgccccgccctctccccgcctcctccctagatatcgcgagagggcgggtccgcttggcttcggcgtcgcgtcgctcctgcgctggagctctaggccggcgtctctccgcgagccgcgggtcaagtggcagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggttttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagagttgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 24447 - DNA, 5582 bp, Homo sapiens
agatctgccctgtagagccttgcggttccactgctggcctccggattcccgggagcccccagcccgacaggacaaccttccttccccgcttcctcctttccagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctgtatgcagaatctga

SEQ ID NO: 24448 - DNA, 5405 bp, Homo sapiens
agatctgccctgtagagccttgcggttccactgctggcctccggattcccgggagcccccagcccgacaggacaaccttccttccccgcttcctcctttccagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcaggtaaataccattactttatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctgtatgcagaatctga

SEQ ID NO: 24449 - DNA, 5414 bp, Homo sapiens
agatctgccctgtagagccttgcggttccactgctggcctccggattcccgggagcccccagcccgacaggacaaccttccttccccgcttcctcctttccagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcaggtaaataccattactttatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctgtatgcagaatctga

SEQ ID NO: 24450 - DNA, 5477 bp, Homo sapiens
agatctgccctgtagagccttgcggttccactgctggcctccggattcccgggagcccccagcccgacaggacaaccttccttccccgcttcctcctttccagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcaggtaaataccattactttatatgaaaccagttctacatcagctggtgatcgatatgattccttgctgggtcgctctggatcatacagttacttagaagaaagaaaaccttacagcagcaggctagaaaaggatgactcaactgactttaaaaagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctgtatgcagaatctga

SEQ ID NO: 24451 - DNA, 4639 bp, Homo sapiens
gaggcagatctgccctgtagagccttgcggttccactgctggcctccggattcccgggagcccccagcccgacaggacaaccttccttccccgcttcctcctttccagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgt

SEQ ID NO: 24452 - DNA, 5721 bp, Homo sapiens
gaagttacgttagattggccgccggtgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctgtatgcagaa

SEQ ID NO: 24453 - DNA, 5582 bp, Homo sapiens
agatctgccctgtagagccttgcggttccactgctggcctccggattcccgggagcccccagcccgacaggacaaccttccttccccgcttcctcctttccagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcaggtaaataccattactttatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctgtatgcagaatctga

SEQ ID NO: 24454 - DNA, 2977 bp, Homo sapiens
atcatatgcttgtaagagaatgagagtattaaccttgtagacttctgtaaggggctaagagaaacactgagctaaataattgaggggatatactatgttcatggcttgaaagactgcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaa

SEQ ID NO: 24455 - DNA, 2925 bp, Homo sapiens
atgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataa

SEQ ID NO: 24456 - DNA, 11108 bp, Homo sapiens
actactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggagttgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcggatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtgggcagagagattgaagaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctgtcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 24457 - DNA, 1687 bp, Homo sapiens
cggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggagttgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcggatttctgctctactggacaacaaagataaggtgcagtttgggagggtatgggggaattccaaggcagttttttttttccatgaaaattcaatcttaggaacaaatgaaaatattttctagtccttaagttgattttggaaatgcaaagtctttaaagagagagaggcacactgatagtttattcaagtagctatttgcttgctattgtttgcttgaccaaaaaagaaaataaaaaagctttaaaaata

SEQ ID NO: 24458 - DNA, 9644 bp, Homo sapiens
gttgctggtacaatctcataaaatgggctccagtgtttagagaaggacagtcagaggagtggccacctgtttgttgaaaattgggcttctgggaaagttgctgcacaagtgtgtggcaaggtgtgtctgagatagcttgacctgctttcacctggaatgatttgatctggcaatagagttccttgccattcctggttttatggaaatcagaggcacaggaagttgatctgggtgttctggggaattgagacaagcctctgccatagtttgttagtactctgtgtttggatgctaactccagtgtgctgagttgagacatcagcaagtgctgggcctggaatgtcagaagcagcaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaagaacctccaccagctaaaacagattcaaaccttgaagcagatgaacgagcaactgcaggctgagaacagggccctgacccgagtggtggccagactctcggagtccatcgagtcctcggacacccaggagctctagttcttgcccctactctccaactcacttccctcctccactactccaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctgtcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 24459 - DNA, 9463 bp, Homo sapiens
gttgctggtacaatctcataaaatgggctccagtgtttagagaaggacagtcagaggagtggccacctgtttgttgaaaattgggcttctgggaaagttgctgcacaagtgtgtggcaaggtgtgtctgagatagcttgacctgctttcacctggaatgatttgatctggcaatagagttccttgccattcctggttttatggaaatcagaggcacaggaagttgatctgggtgttctggggaattgagacaagcctctgccatagtttgttagtactctgtgtttggatgctaactccagtgtgctgagttgagacatcagcaagtgctgggcctggaatgtcagaagcagcaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctgtcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 24460 - DNA, 11111 bp, Homo sapiens
ggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggagttgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcggatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctgtcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 24461 - DNA, 2922 bp, Homo sapiens
gcgggcgggcggtgcgatgtccggagaggatggcccggcggctggcccgggggcggcggcggcggctgcccgggagcggcgacgggagcagctgcggcagtggggggcgcgggcgggcgccgagcctggccccggagagcgccgcgcccgcaccgtccgcttcgagcgcgccgccgagttcctggcggcctgtgcgggcggcgacctggacgaggcgcgtctgatgctgcgcgccgccgaccctggccccggcgccgagctcgaccccgccgcgccgccgcccgcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagcagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactc

SEQ ID NO: 24462 - DNA, 2733 bp, Homo sapiens
gcgggcgggcggtgcgatgtccggagaggatggcccggcggctggcccgggggcggcggcggcggctgcccgggagcggcgacgggagcagctgcggcagtggggggcgcgggcgggcgccgagcctggccccggagagcgccgcgcccgcaccgtccgcttcgagcgcgccgccgagttcctggcggcctgtgcgggcggcgacctggacgaggcgcgtctgatgctgcgcgccgccgaccctggccccggcgccgagctcgaccccgccgcgccgccgcccgcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactc

SEQ ID NO: 24463 - DNA, 2363 bp, Homo sapiens
actccttcctcagctccagttcaggtcccggagcccacccagtgtccacaaggcctggggcaagtccctcctccgaccccctggacttcggcttttgtccccccaagttttggacccctaagggaagaatgagaaacggtggcccgtgtcagcccctggctgcagggccccgtgcagagggggcctcagtgaactggagtgtgacagcctggggcccaggcacacaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagcca

SEQ ID NO: 24464 - DNA, 5227 bp, Homo sapiens
agccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctaacaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaa

SEQ ID NO: 24465 - DNA, 2245 bp, Homo sapiens
attttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctaacaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaattttttttttt

SEQ ID NO: 24466 - DNA, 6251 bp, Homo sapiens
ctctgtcgccgctggagcagctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggcccccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacagccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctagagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 24467 - DNA, 6125 bp, Homo sapiens
ctctgtcgccgctggagcagctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggcccccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacagccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctagagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 24468 - DNA, 4384 bp, Homo sapiens
gcctcagtatctcaaatgtcagcctctactagtcgtacagttctctcttatttgatatcagagagcccaatggagccttctgaagtacctagtcagattagcaaagataattttttagaagttcctaatttatctgactctctttgtgaagatgaagaagttactttccaacctggtttctcccctcaaccaagtagacgaggttctgattcttctgaagacatatacctggataccccatcttcaggtactagaagagtttcatttgctgattcctttggattcaatcttgtgtctgttaaagaatttgattgctgggaattaccgagtgcttcaaccacttttgacttagggacggacattttccacacagaagaatatgttttagccccactgtttgacttgccttcttcaaaagaagatcttatgcaacaactccaaatacagaaagcaatactggagtcaactgagtctcttcttgggtctacaagtatcaagggtattattcgagttttgaatgtttcttttgagaagttagtatatgtaagaatgtctttagatgactggcagacacattatgacattttagcagaatatgttcctaattcatgtgatggtgaaactgaccagttctcctttaagattgtattggttcctccttatcaaaaagatggcagtaaagttgagttttgtatacgttatgaaacttctgttggtacattttggtcaaataataatggcacaaattatacattcatttgtcaaaagaaagaacaagagccggagcctgtaaaaccatggaaagaagttcctaacagacaaataaaaggctgcttaaaggtaaaatcaagtaaagaagaatcatcagtaacatcagaagaaaataactttgagaatccaaagaatacagatacctatatcccaacaatcatttgttctcatgaggacaaggaagatttggaagccagtaatcgaaatgtaaaagatgtaaacagggaacatgatgaacataatgaaaaagaattagagttgatgataaatcaacacttaataagaaccagaagtactgcttccagagatgaaaggaatacattttcaacagatccagtcaattttccaaataaagcagaggggttagagaagaagcaaatccatggtgaaatatgtactgacttgttccaaaggtctctgtctccaagttcatcagcagaaagctccgtaaagggagatttttactgcaatgaaaaatattcctcaggagatgactgtacacatcaaccttcagaggaaactacttcaaatatgggagaaatcaagccatcattgggagatactagtagtgatgaactagtgcaattacatactggcagcaaagaagtcctggatgataatgctaatccagcccatggcaatggcacagtgcaaataccttgcccctcttcagatcaactaatggcaggaaaccttaataaaaaacatgaaggaggagctaaaaatattgaagtaaaagatttgggatgtttacgaagagatttccattcagatacgtcggcatgtctcaaagaatcaacagaagaaggatcttctaaggaagattattatggcaatggtaaggatgatgaagaacaaagaatatatttaggtgttaatgaaaaacaaagaaaaaatttccaaacaatcttacatgaccaagaaaggaagatgggtaaccctaaaataagtgtggcagggattggagctagtaacagagacctggctactctgctgagcgaacataccgcaatccccacccgggcaatcacagcagatgtgtctcattcaccaaggacaaatttaagttgggaagaagctgtgttaaccccagagcatcatcatttgactagtgaaggcagcgctttaggagggataactggtcaagtttgttcatcaagaactggaaatgttttgaggaatgattatcttttccaagttgaagaaaaatcaggtgggattaattctgaagatcaggataatagcccacagcataaacaaagttggaatgttctggaaagtcagggaaaatcaagagagaataagacaaacataacagagcatatcaaaggacaaacagattgtgaagacgtgtggggaaaaagagataatacgaggagtttgaaagctactacagaagaattgtttacctgccaagaaacagtgtgctgtgaactgtcttctctagctgatcatggcattactgagaaagcagaagctggtacagcctatataattaagacaacatcagaaagtactccagaaagcatgtctgctagagaaaaagcaataattgctaagctacctcaagagacagcacgaagtgacaggcccatcgaggtaaaggaaacagcgtttgatccacatgaagggagaaatgatgattcacattataccctttgtcaacgagatacagtaggtgtaatctatgacaatgattttgaaaaggaatcacgtttaggtatttgtaatgtacgtgtagatgaaatggagaaggaagaaaccatgtctatgtacaatcctaggaagacacatgacagggagaaatgtggcactggaaatataacatctgtggaagaatcctcatgggtcattacagaatatcaaaaagcaacttcaaaactggatttacagttgggaatgttaccaacagacaaaactgtattttcagaaaacagagatcttaggcaggttcaagaattatcaaagaaaacagactcggatgccattgtgcattctgcttttaactcagacactaatagagctcctcagaatagctctcctttttccaaacatcatactgaaatttcagtgtcaactaatgagcaggcaattgctgtagagaatgcagttactaccatggctagccaacctatttctacgaaatcagaaaatatttgtaattcaacaagagaaatccagggtattgagaagcacccttatcctgagtctaaacctgaagaagtttccagaagttcaggaatagtgacatcaggtagtagaaaagaaagatgcataggccagattttccaaacagaagagtatagtgtggaaaaatctctagggccaatgattttaatcaacaaacctcttgagaatatggaagaagcaaggcatgaaaatgaaggattagtaagctctgggcaatcactatacacttcaggtgaaaaggaatctgacagctctgcttctactagtcttcctgttgaggaaagtcaagctcaaggcaacgaatctttgttttcaaaatataccaactctaaaataccttatttccttttgtttctgatatttcttataactgtctaccattatgacttaatgattggcttgacattctacgttttgtcattgtcctggctatcctgggaagagggtagacaaaaagagtctgtcaaaaagaagtaacctcagcactactattctctcttaaaagataagctatttaaccccaaacatttggattggtgaatgggactattcattgttcaaagatccagtgcagtttttctcttgaaggatcatttaaaaagggacgcgaataagtttgctccttcatataagtaattattctatataggaccattatgtttggatcattaaatacctatatgaatatgagatctgaagcacgtcaagttgaaattaggtacagctgttgctccttagcaggctatgaagttgcaatgcttcacatctcttcactacttaaagtgctatttcttgcattcatttctcttgcaataaagcttcatttttttttccccttgagagtatatattttcccctacggttttaaaaaacagataaaacatggacaatggcagaggacttttttggtcttttagtattgaacatgaaatttgttcaatttatcatttatcaggattcattgatcaaatatttcaacctttcatatttttaagaaaacacccatatatattgaaatgcaaacttaaacatattctgttcacttgagtgtaatacttgatgcatgcacacacacacacacataccttctttatagctacaaagtcagggcgttcataggcaaaatctgacaagactgaaacaattgggagattatctttcaattctgaaaaattctgtgggtggcctgtctttaagcaatgcttttctcttgtgagggaagactgtaacacagctgaactatttcagtgtcaactattcagaattgaaaatgtaaattaaaatttccacaagcattgcttcagaatgaatttgtacctataaagcataaggcattaaatgacaataaaaattccaaatggactatttgttccacattgtatttttgtcttcaaatattttctaagagaatgaattatccccc

SEQ ID NO: 24469 - DNA, 2524 bp, Homo sapiens
gccgcgggggcaaggcctggagctgtggttcgaatttgtgcaggcagcgggtgctggcttttagggtccgccgcctctctgcctaatgagctgcaccagaatgatccaggttttagatccacgtcctttgacaagttcggtcatgcccgtggatgtggccatgaggctttgcttggcacattcaccacctgtgaagagtttcctgggcccgtacgatgaatttcaacgacgacattttgtgaataaattaaagcccctgaaatcatgtctcaatataaaacacaaagccaaatcacagaatgactggaagtgctcacacaaccaagccaagaagcgcgttgtgtttgctgactccaagggcctctctctcactgcgatccatgtcttctccgacctcccagaagaaccagcgtgggatctgcagtttgatctcttggaccttaatgatatctcctctgccttaaaacaccacgaggagaaaaacttgattttagatttccctcagccttcaaccgattacttaagtttccggagccactttcagaagaactttgtctgtctggagaactgctcgttgcaagagcgaacagtgacagggactgttaaagtcaaaaatgtgagttttgagaagaaagttcagatccgtatcactttcgattcttggaaaaactacactgacgtagactgtgtctatatgaaaaatgtgtatggtggcacagatagtgataccttctcatttgccattgacttaccccctgtcattccaactgagcagaaaattgagttctgcatttcttaccatgctaatgggcaagtcttttgggacaacaatgatggtcagaattatagaattgttcatgttcaatggaagcctgatggggtgcagacacagatggcaccccaggactgtgcattccaccagacgtctcctaagacagagttagagtcaacaatctttggcagtccgaggctggctagtgggctcttcccagagtggcagagctgggggagaatggagaacttggcctcttatcgatgaattaagcaacaatgtaactggtcttgacttgtcatattcccccatgcaatcctaggtctgtattgctcaattttaggaagcctttgctactccatcagtaggtttagatttgagcttttgagacctggctatggaaaagaaagacacttgagaatttagtgttggggtctgtacagatgatgctacccaatttggctttgaaggatcaagtaacaggttgaaaactatttttataaaggtaatactttttcagttcccttcttccttccctctcaatccactagctttcatgttgggcaaggaaaagttgaggaaggatggctgatggtgatggaaagctgtgttaatggtatgaggaatgtgtgaaaagtatacacaaagggctctgaagctcaagtcagaggagtgggaggtctgatcattgttggtggaaaaacgtaaggttattttgtgtttttaagttggttttacaattctttcctggggaaattatttctggaggggaaaaagatccattctacgtatccttgtggagaaaagctaaataacctttaagaatgtgggtggtattggagaaagaagatgaattatagctccggagaatcaagatcttaagtgaagcctttctgttcagatgtgatctataaaaaatcataatttggggaaagtttaagcaaatctggctttgtagtcctgatgttataagtgactttgtgatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatgggtttttggcctcataagatggtccactctgtacacaggcattcctcctgcaataatgttgtatctttgagaccgttgtcagtgtacacaactcacatccttcatattgaaggtgactcatttttctgcacacttttttgatgtgatgcttgacgtgaggcccgacactaggattctcaatgcaagaatccagtaccttgcacatagaagtagcaacccatcccttgcctattttcatcttgctgttttcttttttttaaaaaaatggatgtgacttgttttgaatgttttgtattatacttgtttttgtgtgtgcataaattcattctgtaggatcttaagaaaaagagtcccagaatgttgcttctattattgtgcacaaccattgagaggtgttacaagaatgcagttaattttaacatgtgtgatgtgccatggtggaaaagtactatcggaataactctgcagtgacagaatttgaagtttggctagcatccatacttttctactgtaaatatttcactctcctctagctatccttgatgagcttctcactttaagaataaatgtgtttgatataa

SEQ ID NO: 24470 - DNA, 1375 bp, Homo sapiens
agggtccgccgcctctctgcctaatgagctgcaccagaatgatccaggttttagatccacgtcctttgacaagttcggtcatgcccgtggatgtggccatgaggctttgcttggcacattcaccacctgtgaagagtttcctgggcccgtacgatgaatttcaacgacgacattttgtgaataaattaaagcccctgaaatcatgtctcaatataaaacacaaagccaaatcacagaatgactggaagtgctcacacaaccaagccaagaagcgcgttgtgtttgctgactccaagggcctctctctcactgcgatccatgtcttctccgacctcccagaagaaccagcgtgggatctgcagtttgatctcttggaccttaatgatatctcctctgccttaagtttccggagccactttcagaagaactttgtctgtctggagaactgctcgttgcaagagcgaacagtgacagggactgttaaagtcaaaaatgtgagttttgagaagaaagttcagatccgtatcactttcgattcttggaaaaactacactgacgtagactgtgtctatatgaaaaatgtgtatggtggcacagatagtgataccttctcatttgccattgacttaccccctgtcattccaactgagcagaaaattgagttctgcatttcttaccatgctaatgggcaagtcttttgggacaacaatgatggtcagaattatagaattgttcatgttcaatggaagcctgatggggtgcagacacagatggcaccccaggactgtgcattccaccagacgtctcctaagacagagttagagtcaacaatctttggcagtccgaggctggctagtgggctcttcccagagtggcagagctgggggagaatggagaacttggcctcttatcgatgaattaagcaacaatgtaactggtcttgacttgtcatattcccccatgcaatcctaggtctgtattgctcaattttaggaagcctttgctactccatcagtaggtttagatttgagcttttgagacctggctatggaaaagaaagacacttgagaatttagtgttggggtctgtacagatgatgctacccaatttggctttgaaggatcaagtaacaggttgaaaactatttttataaaggtaatactttttcagttcccttcttccttccctctcaatccactagctttcatgttgggcaaggaaaagttgaggaaggatggctgatggtgatggaaagctgtgttaatggtatgaggaatgtgtgaaaagtatacacaaagggctctgaagctcaagtcagaggagtgggaggtctgatcattgttggtggaaaaacgtaaggttattttgtgttttt

SEQ ID NO: 24471 - DNA, 1285 bp, Homo sapiens
agtctctcccagcgaccgccgcgggggcaaggcctggagctgtggttcgaatttgtgcaggcagcgggtgctggcttttagggtccgccgcctctctgcctaatgagctgcaccagaatgatccaggttttagatccacgtcctttgacaagttcggtcatgcccgtggatgtggccatgaggctttgcttggcacattcaccacctgtgaagagtttcctgggcccgtacgatgtcttctccgacctcccccttaaaacaccacgaggagaaaaacttgattttagatttccctcagccttcaaccgattacttaagtttccggagccactttcagaagaactttgtctgtctggagaactgctcgttgcaagagcgaacagtgacagggactgttaaagtcaaaaatgtgagttttgagaagaaagttcagatccgtatcactttcgattcttggaaaaactacactgacgtagactgtgtctatatgaaaaatgtgtatggtggcacagatagtgataccttctcatttgccattgacttaccccctgtcattccaactgagcagaaaattgagttctgcatttcttaccatgctaatgggcaagtcttttgggacaacaatgatggtcagaattatagaattgttcatgttcaatggaagcctgatggggtgcagacacagatggcaccccaggactgtgcattccaccagacgtctcctaagacagagttagagtcaacaatctttggcagtccgaggctggctagtgggctcttcccagagtggcagagctgggggagaatggagaacttggcctcttatcgatgaattaagcaacaatgtaactggtcttgacttgtcatattcccccatgcaatcctaggtctgtattgctcaattttaggaagcctttgctactccatcagtaggtttagatttgagcttttgagacctggctatggaaaagaaagacacttgagaatttagtgttggggtctgtacagatgatgctacccaatttggctttgaaggatcaagtaacaggttgaaaactatttttataaaggtaatactttttcagttcccttcttccttccctctcaatccactagctttcatgttgggcaaggaaaagttgaggaaggatggctgatggtgatggaaagctgtgttaatggtatgaggaatgtgtgaaaagtatacacaaagggctctgaagctcaagtcagaggagtgggaggtctgatcattgttggtggaaaaacgtaaggttattttgtg

SEQ ID NO: 24472 - DNA, 3459 bp, Homo sapiens
aagtaacgccgcggaccgggaaagtgggaggggccgctcccggaacgcagccttcttgtaagaacctccaaggaagcaagaagaaaaaagaggcgctaccctgcgctcccgggaggcctctgaaagcttccactagagaaaaactccccactcttacaatttctttaaccgcaagaagcggaggacctggacaaggactcgaggagcaaggtggcgaaccaagggtagggcgcaccgggcccgagaggtcccccgcaggttgcagatacggtggactctctgcggcttctgagcacggagggagctgtcgcggggtcgggaggtcgtctctcatccctgcctcatcttccgacggccggcggggccatgtccagaggcccgagctccgcggtcctgcctagcgccctgggatcccggaagctcggcccccggagcctcagctgcctgtcggacctggacggcggcgtggccctggagccgcgggcctgtaggccccctgggagcccgggccgcgcgccgccgccaacgccagcgccgtcgggctgcgacccccgcctgcggcccatcatcctgcggcgggcgcgctcactgcccagctcccccgagcgccgccagaaggccgcgggcgcgccgggcgctgcgtgtcggccgggctgcagccagaagctccgcgtgcgcttcgccgacgccctgggcttggagctggcacaggtcaaggtgttcaacgcgggagacgacccgtccgtgccgctgcacgtgctgtcgcggctcgcaatcaactcggacctgtgctgcagcagccaggacctggagttcaccctgcattgcctggtgcccgatttcccgccgcccgtcgaggccgccgactttggcgagcgcctgcagcggcagctcgtgtgcctggagcgtgtcacttgctcggaccttggcatcagcggtacggtgcgcgtgtgcaacgtggccttcgagaagcaggtggctgtgcgctacactttctcgggctggcgcagtacccacgaggcggtggcgcggtggcgcgggcccgcaggccccgagggcacggaggacgttttcaccttcggctttccagtaccgcccttcctgctggagctcggctcccgcgtgcacttcgcggtgcgctaccaagtggcgggtgccgagtactgggacaacaacgaccaccgagactacagcctcacatgtcgcaaccacgcgctgcacatgcctcgcggggagtgcgaagagagctggatccacttcatctgagccgcgcggggaccggccacctggagcctccacacctaagctgcgcctcctgtcatttccctgctgggctctcacatctatctggttgttcttcaccaccctccaagtcctctgacctaattttctgctgcaaggtcccctggcagtggcccatcctgtcttctacttgaaacgtctgagtcacttggtctaaaaagtagcctcaggtggccagaaggccgagttgtgtaatgagttggggcagggtggtggggtaggtgcatgggagggtgggccctctggggaggcccaagcagcttgttttgcaaaggcccaagtcctcctgctaggaaaagcttttgcatgtgtcctgaatgtgtctctgtaaacatagctgttatttattattgtgatgttgggacctttagcccatagcggatgcctcctcaggaatattctcgatttaataagctaaaaaaaaaaagttctgtgtttgtgcccacagtaaacagaatgtacagtgtgacccacatcgtggtccctccaggcattcctgccccaggataaggaaaacctgagcccacatctgattgccaacggctgtagccttctaacagtgggaaactattaataggcaagaaatttctgctttatcagtcatcacacaaccattcctgggcattgagactgtcctggttaggctgtgtgtctcctacattaacagctggggaggagggaaaagcttcagacttttaaactagcaaaacagttatttctctgcattcacaattctgatttcatgtatttctctgtacatgtttgatcattatcaggccattctgtttaagtttgaaactaagcattttaagaagtcttgcctcagttatttcagttttcaggtgactagagaatttcaggcaacagtgccctttgcaattacctttttgatgattaaggtgactatttttatttcttgttaagcatcagaagatgtcagcattcatcttttgggagtccagttacaaggtggaactagaaggtgttttcagcaatagccagagcactggaggaaaaataattgacaaatatttatacttttaaattgttttgaactgtatttacatacatcatgttttatcaggtacccaccaactttatactttctgccttcagatagagtttctaacattttctagtttgtcagttttaaaatataaaattcttttatgtttttaaaccgtcaaccaagaagtcaagaccactgtcccctgctgagttaggcaatcacttaaaactccaaagaactccaggctgaggagttcttttggtgctgaacagtggtctgacaacaggtgctagaattaaggtgtgggaaaaaaaaaaaaacagccaggaaggacaagatctccaatttgtgaagcttatgatacagctgaaaccagtctgatcaattttatgctacctgtcaccaagaaattaactctaaatttttgaatgcttgttggcatctgtcaaatcaatactgaaaggatgcatttcggcttttaaccagtttggttctgatcattgcaacctctgtgcttttataattcaaagaacaaggatagctttcttcggtatcttttaatataagaacactgaattttggcttgaaatattgtgactaaattgcacaatctctggctattagcactgttcactacattaacatgcaagagagagagaagccttgttacatttcctgctatttaacaaactgtccaattaggtcagcaagcctgttagggccttcactgctacgcccctggccccaaaacagagagcaagacagttgtccagagaatttagatatgagttaagagctgccagatttattttaaggcatgtagagaatctcataatctatgtgaaagtcacttgccaaaaaggttttggttatgaaagtgaatgttatatatttaatattaagtgaacctcccgtgccttttaaaaaataccaacattatgaaatttaaaagcttaaatatatttgcctagttgataaagaggctgtggaacaactgaaggagaactttcagaccctaaaacagttatattacttagatgttaaaattttctagtgggctgtgcaattgctgggttgtccccccaaacatattttaatatgttatttaaaatgattttacccaagcctaagtattaaagtatatgtgc

SEQ ID NO: 24473 - DNA, 2386 bp, Homo sapiens
agacgcagccagcgaggctcgcagaggtcagggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgtcacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagaca

SEQ ID NO: 24474 - DNA, 1954 bp, Homo sapiens
cgcccccgggccgggcagatgcggtttcctcccgactcgcgatcaaaatgggtgagtagcgcagagctcgcctcttggaggcctctttctgaaggcggaggacgcggggcggctcgttcatgggccgggtggctccgcagggtagacgaaggctgcagcgtccgcactgggctgggaacgacttgcaaggggagcccagctggcgccccggagccagccagctggctagcggccccaccagcgcaagtgccccgcacctgcccgcctgctccgagcgtcaagagaaggcggcatttcgcatgggtaaaatccgcgcggggacgccgggagaatgttgttgctcttgccgttcggcccattgtacagacgcagccagcgaggctcgcagaggtcagggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgtcacacacca

SEQ ID NO: 24475 - DNA, 820 bp, Homo sapiens
atggcggcggaacgcggcgcggggcagcaacagtcgcaggagatgatggaggaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaatgtgcaggacagcctcacgtactgaggggaagtgtgctcacagagcccccaccctcctcagctgcctccagctcaccctgctctgccccagtgcggtgttcaagacaaataaaagactttttctcattcaa

SEQ ID NO: 24476 - DNA, 965 bp, Homo sapiens
gggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaatgtgcaggacagcctcacgtactgaggggaagtgtgctcacagagcccccaccctcctcagctgcctccagctcaccctgctctgccccagtgcggtgttcaagacaaataaaagactttttctcattcaa

SEQ ID NO: 24477 - DNA, 1592 bp, Homo sapiens
aaaggaataatgggcgcctccgcccccgggccgggcagatgcggtttcctcccgactcgcgatcaaaatggcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgtcacacaccattttcagatgccgttgcaattaaatcttgccacactgtc

SEQ ID NO: 24478 - DNA, 2414 bp, Homo sapiens
aaatgggagggggagacgcaagatggcggcagccgcgaactccggctctagcctcccgctgttcgactgcccaacctggtgagtggcggggcggccagggctagagtggcccggccggagctagcctgggctggaagggcggctctttttttacttttctgctgcgagccgaacggctcagaaaccccggaatggttgaggaaaaactgtttgctgcaccgggccgggcgacgtgttgaagaaccgagagcctggagcccaggcccaggaactgaagaaacccggggttgggggctcaaaggcgctcacttaggcagcccctttgagcgattagccagtcgccggagcgcttcgaggccttggcccgaacttacgcccaactcttgactgagtgcctggtgctctcgtggagcatcgcatctggccccttcctgtacgtcccgagcgcgctcgagccagccccggccccaaccctacctccaagccccgcatccctctgtggttgctgcatccctcgtgcggcacttgtctgtctgccacagagaatacgaggggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtaaacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtca

SEQ ID NO: 24479 - DNA, 2344 bp, Homo sapiens
cggtcttccagtttcccggcgtgcttagggcgcgccaaatgggagggggagacgcaagatggcggcagccgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcatttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtggaaa

SEQ ID NO: 24480 - DNA, 2651 bp, Homo sapiens
gggggagacgcaagatggcggcagccgcgaactccggctctagcctcccgctgttcgactgcccaacctggtgagtggcggggcggccagggctagagtggcccggccggagctagcctgggctggaagggcggctctttttttacttttctgctgcgagccgaacggctcagaaaccccggaatggttgaggaaaaactgtttgctgcaccgggccgggcgacgtgttgaagaaccgagagcctggagcccaggcccaggaactgaagaaacccggggttgggggctcaaaggcgctcacttaggcagcccctttgagcgattagccagtcgccggagcgcttcgaggccttggcccgaacttacgcccaactcttgactgagtgcctggtgctctcgtggagcatcgcatctggccccttcctggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcatttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtg

SEQ ID NO: 24481 - DNA, 1148 bp, Homo sapiens
ggagacgcaagatggcggcagccgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggctgtgaatttgtctctcagtcactgattgccactgccatctggaaatgtttgctaaaggcacagtcactgggcttgggaggcaatgctccatccccattatattacaaataa

SEQ ID NO: 24482 - DNA, 1029 bp, Homo sapiens
tccctcgtgcggcacttgtctgtctgccacagagaatacgaggggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacacctt

SEQ ID NO: 24483 - DNA, 611 bp, Homo sapiens
ggagacgcaagatggcggcagccgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaaccacatggcatccatgggacagcactcatcggtggcttgcccatgccatacccaaaccttgcccctgatgtggacttga

SEQ ID NO: 24484 - DNA, 10219 bp, Homo sapiens
atgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccagcaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaagaattttaccttcaatgatgacttcagtcccagcagtaccagttcagcagacctcagcggcttaggagcagaacctaaaacaccagggctctctcagtccttagcactgtcatcagatgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggtcactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttctttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctattagaatggtttacattatgatgggggatggggagctgggggagggctgtacattcccaaaagaaagtagtgttataggaaatccaaatgcgcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactgaggtctgttgaagcaa

SEQ ID NO: 24485 - DNA, 9689 bp, Homo sapiens
ctctcccgggattttgctgccgggctccctctctctgcggccctagagttaatcccatcagccgagatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagaattttaccttcaatgatgacttcagtcccagcagtaccagttcagcagacctcagcggcttaggagcagaacctaaaacaccagggctctctcagtccttagcactgtcatcagatgagagcctggatatgatagatgacgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggtcactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttctttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctattagaatggtttacattatgatgggggatggggagctgggggagggctgtacattcccaaaagaaagtagtgttataggaaatccaaatgcgcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactgaggtctgttgaagc

SEQ ID NO: 24486 - DNA, 555 bp, Homo sapiens
actgagcctttagaaaagggcggggttcgggggggagtgagctgaaaaactctccctagacaggaaaggtagaagacctcctcatccctttctctttggcagtgagatcttaaggtcaagatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatg

SEQ ID NO: 24487 - DNA, 512 bp, Homo sapiens
gcggccgccgcagccgccctacgcgctgcgccgtgaggagcgggttgcggtgtacccagcgggccggcgccgagccgagccgccgcgtccaccgtggggcggggggcgcctgcgaggagggggtgggagccgcggcggcccgaccctccccgcccgcggcgctcccgctcggatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatgggg

SEQ ID NO: 24488 - DNA, 9928 bp, Homo sapiens
attatcagtgggatctattgtttcctggcacattgggaggaaaaacaaagggatttattttcattaccctgtaattttttttcttttctatttttttaaatgtggccagggagctcgtctctctccgtgtcacagtgggatccgcctggcagccgccgggagctgcagccaatgtgttaggacttcaggtgcttcttggcacaaagctagactgcgacctcctaccatagcgcttggcgtcacctgctctcccggtcctgccccagggccgagggattgcgtcccgaaccgggcttgggaatcggctgcctctcaaatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagaattttaccttcaatgatgacttcagtcccagcagtaccagttcagcagacctcagcggcttaggagcagaacctaaaacaccagggctctctcagtccttagcactgtcatcagatgagagcctggatatgatagatgacgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggtcactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttctttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctattagaatggtttacattatgatgggggatggggagctgggggagggctgtacattcccaaaagaaagtagtgttataggaaatccaaatgcgcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactgagg

SEQ ID NO: 24489 - DNA, 10090 bp, Homo sapiens
atgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccagcaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaagaattttaccttcaatgatgacttcagtcccagcagtaccagttcagcagacctcagcggcttaggagcagaacctaaaacaccagggctctctcagtccttagcactgtcatcagatgaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggtcactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttctttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctattagaatggtttacattatgatgggggatggggagctgggggagggctgtacattcccaaaagaaagtagtgttataggaaatccaaatgcgcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactgaggtctgttgaagcaa

SEQ ID NO: 24490 - DNA, 4649 bp, Homo sapiens
cttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggagcagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccgaagacaaaaatggtacttaaagtggcagtgttcaacatttaatgagtttttccccttttatccttcgaataggattagatgtttaaaaaaaagttcttctgtgggaactaatatttgatattttaacctaccagagtaaacaggaacacttaatcatacttgtgagtgtagtaaataaaagttttcttgctttgtgctgtgttgaatctggaaccaacagggaagttatagcatatcccctttctaaaatgcttgaggaacacatacataccgaatgtcttttctgatctaattgatagtatttttagtggcttgtggagttaattttccaaagcaaaaggccattagggtttctacatttcatttcatttcattcttttctttcacaagaaatacattctctgtgtgtctttttgttgctctgtcactctatgccctttctctccgactgaacaaatagcttatccatgtgcagtggttttaatacccaaacaatctagacaccaagcagctattttttccggtcctgtgatatcagaattgaccaaggaatacgtatattgtaattgacacgtggtggtatcttccaggtacaaattctctaaattttgtggttagcagaatgggacttgtgataagaatagcttggttttagcataactagggtttaaaataattgtttaattatagagactgaccgggctttggccatctaaactggaaagtgttagtaccctaccttcttttgaaaatggctatggtaaggaaaatgtgttagtaaattatgtattttcttgaaaaatacataattatggttggatgggaatcactaagttgggtgttaactgatgtctcaattagtaacattaggattttcattaataaacctaaaaagctttccctaagaacaggcctggcacagtggctcatgcctgtaatcccagcactttgggagaccagggtgggtggatcccttgaggtcaggagttgaagagcagcctggccaacatggcaaaaccccatctctacaaaaaatatgaaaatcagccgggcttggtggcataccatagtcccagctacttgggaggctgaggtgagaggatcgcctgagcccaggagatggaggttgcagtgggctgagattgtgccactgtactccagtctgggtgacagagccagaccctgtctcaaaaataaagaggattctgagtttgtatagtgagggcttgcagaaattttgaaacttattttgtaagtttacaatgaatttgtacatgatgtgctcatgtcttgggttgagtatcctagacatgattttttcatttgctgcatattaaacatttgttggttgtagtcggtatttcttaaatagaagtttgtcaatattagattagtttcaagaaggacttagctcaggaaaaggatagttatttctgtggttctcagctttgatgcctacagagattctgatttaaattgctggaggagggcccaggcatacattttttaagtttcccaagtgattctaatttacatctagggttaaaaacagccaggcgcggtggctcatgcctgtaatcccagcacttggggaggccggggtgggtggatcacctgatgtcaggagatcgagaccagcctggccagcgtggtgaaaccccatctctattaaaaatacaaaactgaccggtgtggtggcaggagcctgtaatcccagctacttgggaggctgaggcaggagaatcacttgaactcaggaggaggaggttacagtgagcccagatcgtgccattgcactccagcctgggcaaaaagagcaaaactccatctcaaaaaacaaaaacacctcactgctgtttcctaagtacatacttaagaaaattgggatacatggtggtggttcatggatgttgataaggaattaaaatgtaccgtgcgactctctgtttcagtggtgacttttacctgtttagtataaatattcctttgcttccaaccataaatgtgttcttagaaatgggcctatagtttagtaacctatagtttggtaataggcttgtttgttttcagatggattttggttctgtgagctaaagctattttgcattaaagccttcgtcctca

SEQ ID NO: 24491 - DNA, 2006 bp, Homo sapiens
cggcggaaatgcccgagcgatgacggaaacccggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaacattca

SEQ ID NO: 24492 - DNA, 1723 bp, Homo sapiens
aagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaac

SEQ ID NO: 24493 - DNA, 3123 bp, Homo sapiens
cgcagagggccggggctacggggcagcgccccgggcgatgaggggccggcgttgaccgggaagagcgggcaccgcggcagtggctccgaggggacccgcgatggcagcgccctgagaggaggctccaggcagggcgggctgcgctggcagcggccgctgaggtgctggccggccggctggctggcgacgggggcagaagcgacgagaggcgcgctcggcacccgcacccccgtgcccccgcctcagttgtctaaacttcgggctctcttccacccgctctgcgcgcccagagtcaacaacttcttcacccccctccgcccccgcccttccctccgtcagccccgggagctcgccgcgcgccggggaccaggaacctccagcgctgagatgtggccgtgaggcgttggcgggcggcgaggagaagctcggcggcgtcccggggccggagggccgtggggccggggcgcaggggcgcgagcaccccgcgcctctcccccgcctcctcctgccgtctccgccgctgcccgtgccttgcaagcagcagccggagctgccaagcgtcagggccgcggagatgtcgtcgtcgtcgccgccggcgggggctgccagcgccgccatctcggcctcggagaaagtggacggcttcacccggaaatcggtccgcaaggcgcagaggcagaagcgctcccagggctcgtcgcagtttcgcagccagggcagccaggcagagctgcacccgctgccccagctcaaagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtattttg

SEQ ID NO: 24494 - DNA, 1719 bp, Homo sapiens
atgatacagtgcttgttctataatttgtagcatgaatcctatatgagatcttactttagatttcaagtatgttagcagcagtaattagggatgttttcctctaaggaaaattatagttataaaattattatttgttagaaatgattcctgctacttcaaattatttatccttaaatgtagaggattaacaatgaacaacttgaaataacttggttatcacctcagaagtttagtttatcactgatttaatgaagaagggcaagaagaggaaggctttatgataatgaatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgt

SEQ ID NO: 24495 - DNA, 1850 bp, Homo sapiens
gtagcggtcgctcgcctggggttctccgtgggcggccgacgggcccgtgcccccgcctcagttgtctaaacttcgggctctcttccacccgctctgcgcgcccagagtcaacaacttcttcacccccctccgcccccgcccttccctccgtcagccccgggagctcgccgcgcgccggggaccaggaacctccagcgctgagatgtggccgtgaggcgttggcgggcggcgaggagaagctcggcggcgtcccggggccggagggccgtggggccggggcgcaggggcgcgagcaccccgcgcctctcccccgcctcctcctgccgtctccgccgctgcccgtgccttgcaagcagcagccggagctgccaagcgtcagggccgcggagatgtcgtcgtcgtcgccgccggcgggggctgccagcgccgccatctcggcctcggagaaagtggacggcttcacccggaaatcggtccgcaaggcgcagaggcagaagcgctcccagggctcgtcgcagtttcgcagccagggcagccaggcagagctgcacccgctgccccagctcaaagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataa

SEQ ID NO: 24496 - DNA, 2008 bp, Homo sapiens
cttgggggcttctgagtttgagctgcatgcagaaatgtaaggcagtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcctttcttccagctgccacacagaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctt

SEQ ID NO: 24497 - DNA, 2367 bp, Homo sapiens
atatcctgctggatttctcttgcgaaaagagaaactcaccacacgggaaaaggtagaggtttcaggcagagcatttcagcgtgtgtttacaggcaggactgacttactcagcaaatcctgttcagaggagcttcagccaatgaagaggctatatcccggcttgcttgggggcttctgagtttgagctgcatgcagaaatgtaaggcagtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcctttcttccagctgccacacagaaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttag

SEQ ID NO: 24498 - DNA, 1506 bp, Homo sapiens
atggtgcttcagccaagtgaaaggcactatcgagattggaaccacagaaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactag

SEQ ID NO: 24499 - DNA, 2012 bp, Homo sapiens
agtcacacaggggatgactgcaagtccttcgtaaccactccaggacgctgccagggcctgagaagggacaaactccaattgctccagttcaaactggtcctggcctggtcaaacggaggagacagagcagtgattcacagcaggacgtggaattgggacactcacccaggacacactatggtgcttcagccaagtgaaaggcactatcgagattggaaccacagaaggagccaagggagaacccaagacagagaatagtggcccaataatgaagcatgaattatccagatgaaaacacctatggaaataaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttag
